United States Patent 10,221,454 (METHODS AND COMPOSITIONS FOR SCREENING AND TREATING DEVELOPMENTAL DISORDERS) - sequence listing, part 2

SEQ ID NO: 77 - DNA, 674402 bp, Homo sapiens
aagcagcgctcatggcgaagaggcttaaggccacaaaaccgtgggacagcaggaggaagagaagccaggtatctccactccagctgccctgcctcagactcctcagtttcgcacgtgaggatcgtcttgcaggcactgactggagatggaatcctaaagcataggtgaagcggaaatcctccttcagggagagcccactgaggaagccagcggctagcacgaggcaggacaggatacctccctcttcgcccacggcggcctctctgtcatagtagccaccgttctgccactcatgcagctttctaagacacctctcggttccccagcgctttcagtggggcggccggccattcccgagggttgcaagaggaggcccggggtgctgagccagcctcgctgcccccgcgtagaaagccggcccgccggcgagagccagcctaaggcgcggacaaccaacgaggtgtcaggctcggcaggggattgcttctgtctggggcccggccgaggttgcgttcgtgcctcgcgcgcacacgctccgcgttcactcagccaatccggtgctactcgcgcgcccaggagcgatccgcggtcctactcaggctgggccggctccttcccgctcccaatactcagcacccgagctctcactcctcccctcactctccacgagttccacgcctaggggtgtagctccgcccttgtccccgagtccgcccccgcaacctccagagcgtgtgctatcctttcctctcagtcctgccatctagctgccttgggtctcgcgctccgcagagcgttccgacactctccggcctcgttctgccgcctccgcgcgctctccccgtgcggccaccgcgccccccaagcttgcctccttcttgccggacttggggccgcgcgccctgactccttcccctcccgcggacccgcgcactcccggcgcggcctctcccccacgcaggccaccgtgcactctgtggcctccccctccttccccgctctcctcgcgcttctctggctccctagctgtcgcgctctcctcggcgagcgcgctcccggcccgcgcgctccgggctccggtttctcccggctcctgtcagtgcggtgactgcgctgggaaacatggcgaccgagggaatgatccttactaaccacgaccatcaaatccgtgtcggagtccttacaggtaaccgggggaggaggtctgggacctatgaggctgctgtccctgcattgccttaggcttttcgcctgtggtggcccttctctgcggcctcgggaggagggaaggctgaagaagggaaccgcgggggtgcattttacaaccgctgagaaccgccggagattgggggtgttcccgcgggtcccctcccccaggccccaggagccggggtcgaccccgtgggatgttaggccccagcgccttcggaagcaaagtcctgggcccccggggaccgaggggccggtgcggagggcgctgcggggctccgcgctgtcggtgcaggcggcgggatcccggctccgcagtctgaagcatgccgctctcggctggcctgggcgcatcctccgctagtgctcttcagagagaggggggaatcccatctccacccccttcctctccttcccttccccccacctgggcggccccacgccagtatctgtgcttgcctggacgagactcaggtgttaatcagatgaaactgctcctcctcgggttgtccctcgcgggccgggcgtcccctcagccacccatggggcacccttcgcctccctcgggggatgggggatcggcttgcgtccggacctcggaaagtgtctgccttctgcctttccgcgcaaaaggccctctgtctgcctcgtcgtttccttagcgaggacgggctgcagcctgctgccggggatccagctttttacttgagagggcaggattcccctactcgggctcctctccccctcctttctgggaacccccaccccggtagagcgtcccgaggctggtgaggagcgcacttttcccgggtcgcgtttccctccctcgcgaaagccgtgtgtgttctgcatgtctgattccgttgcgctgaatttggttaatatccgtcacttcggcgatcggcagttgctgcagggcatgacttccaagatgaacagcaagcggatttgtaggggtttctgctgtggttctgtaattggcaaggtttatgtgtaattgagtggcgagacgggggttaaagaactatatttggaatctgagggcttagtttggagtgaaggaaatccaagactcagtgatgtgatttcggaaaaagaagcagtgtggacgggaatcctagtgtttcccttacttctttttttaattttttctttaactgtcaaattctgacaggtcgagacggtgctcgagaagggactaaattgaataagacttgcttttattattaggtagaaaaaaaatgtctgagactgccggcagatattgagtgcaaagcttaatttagctgctgaattttatgaaaaggtgatatccaaagcctccttttttctcttttaagtaaaggattgcctttccctggtattctttccgtatatcgatggtgattaattgaattttcctaattaaaagacccttggatagagaaactagtctaaaccagttgcagaaaagggaacccccaaatcagaaggtgcgctgttctcttcttttggtcctgaaactgtttgggtatgtgaagattcagttgtatttcagaattcctggagctgacattgccaattttcgaataatctgatggtgggatgtcaaagtgtatatcttttatctaccctcaacttgcactttaaattccagccattctttgacaataatagagtagtgagaaaccaaaatatgtcagttgtctgtggaaataaaaaaggccatagatgtttaaaagttaaaccgtagaaacatttttaaaatgaacattttctacttaagctttccattaaataatagtttcatttaacgaatcaacttacctttgtgaagtgacatagcagataggtgttgtacagactgctttgaaagatgcagcccttatctggtgtccctacagtctaatatggataacattgatacgcaaacaaatgaagaaacattgtatgtaattattgtgcaaaacttttctaaatacattacctatgagtttggggttaactgcaaaagaaattccgtattcagatggattaggagagaatgtgactacctgaagggagaatttaatacatttactaggtcaagaagaaactgtcaattttaaggggagttgaaagtcagcagccactttataaataaatatatagttgatgatgaggcttctgagctaaataaaaatgcaatgtaaaggccttgaaaagctgaagtggaatgggtaggtggcataggtaaaatgttagagagaaggtaacattaacattgacagtggaattaaagacagtcaggggaagccgtctcatgagaatgaggtacagtagtctagggggaaaagtctagggccaggaacaaggatgtagctgaaggaatgaaaaggcagctacagatttggaataagtgataatagaggaaaataggttttgatgataacatgtatatttgaagtcagaagtaactcaggctttttcttgaaagttgttgatacagatattgtctactatgatggagaggaaagaaaactgatttttctcaagtctgtaactagtgggtttcattatcaacagcttaatttctgtggtcttgcctgatataccatatgatttgggggaaagaacttacaaaaatgaagctgtgctgtacaattttgtgtattctagaacttgaggttttgcagttttactatgtagaattattctttactgaactgaagtattgtgatttcatacttaagaaagttgagttgaactgtggtttttgtaaattattatttgtggctcttaaaaggtggagggtctcttttagaaaatctccttggcatgcttcgtaatactaattttaagtattttatctatatctattttacaaagatagtggaaagtgtgatctacccacacacacattttacaatatgttacttagtattttgtgaagtcatattgtcatttctaaagtttttaattgacgttgtgacattttttattacctgttgaaagatatttgttctttgaaacttttcatccattagatgttttcgttatcttcatttcagttgtaaatttggcaaatttagtacatagtctgttgagacttctcattaaataaattaattgtattaggtttatgaaagaataatggtagaaagggaaatatttagcagaagcatttttttgcttcattattttgaattattaagcacttgaaaatgagattatgataattaatgtaacatggatattctaattatacttttttttaaatcaggaaaatgagaacatatatgtatataaaataggctgtatgtggaaacattttatgttgaatattattgtccatctctaacaacaataactttgttcgaaactgtcttatgttgacttgacagaaatgaaagtcacatggtgtttggtgacctaaggtctagtttgaaatatttctgtgtctaattagttgtctacttgtattactatttatagaagagactagaggtaatatggtaatgagtaacatgaagcaaataaacaagtatctgctacttgaaaactagaaacaggatgtggtgcagatgtagaatttttttctaacagctttagtagtgattatacttgaagtcaatcttaccagttacatagcaggctcactatatctggaatatgtcactcttcacatacttttttctattttgaaagaagctgtttatcaaagcagcatactagttttacctgtaaaagctctacagaaacattactaggaaaataatgactacatgtatgtatagaatgtagaatcatatagattattccattggctactgaatatcgtattagttcgctacagctaatgtttgataccaaggtacttagctgaagatgataatccattacctaaattgtcactaataggggcatgaatgagaaaaaggtacaaatttttgggaaagggcatttttaaaaatcatatttttgctgtagtaatatacattttaattgcactaacctgttgatttgaaatcagtaagagatactggaacaaatataagactaggtactagagattagttaaaagactaattgtaaatgagaacatcaaaatattacagtaacaggtagggagtatttcagttattcataaatgaagtcattcaaagtattaaaaaaacaagcttgagccaagcagatgctactgtcataactctgcaattgtttaagcatttacttttttacattcttgaaacctgttctggtatattatgtgtcaatattattttctgaaaagcccatttattgataaggatatatacatattatatctgttttgagaatagatgtcattaagtaggcaaattactattaaatcctactaagtggaactgtatgttctgcctaacttagctgtttttttaatatgtgtttttaatattgatctatatgacttgaaaggaatcctatttcttgaaatagattgttattttgtgaattttttgttgaaagcaatgtattagagaattaaatgtttaggcaaagtaggaaaatgttaaattaatttctaatgaatatacttagtactattatcattggtcaaagacttgaaaaagtattagttgctatacaataagaattttaactatattaaaaacacatgtgacaatttgacttcaaagtgaatatacttaatactatcatcactggccaaggacttgaaaaagtattagttgctatacaataagagttttaaatacattaaaaacacatacaactatttgacttcaagcaggcatatagtggaaagtcaatagtatgtttttagggaggaagtgacgaataagagtctatttttaatcttgctagtgatagattcctggctaagttgaacagggtgtttttaaaaacaatcagtaaaatagataaaatctattactctgtttctgtaaataggattgaagaataatgaagcatatttggaatttgaaaggtattaaaaaaagatcctgaaaaagaaagtagtgaaaccacaaaggatttcttccttcacatctgggcagagaagataaataccaaggaagaagaaaagattgtttaacctacttaaaagtaattgggactgtagtcaatatgaatggcatctaatctcactttcattaaaaagtttttttgagtgacctctcaaaaaggaaatgtttaatgaagtattgctaggtagaagttctatccaggttctttaatgaatttataaactaaattgtttttaataaattaattttaactaagtagagcttcttgaaaattttgtgtttaaacaaccccaacaattttaacagtagctttgtcagtatttatacatttcgaaagagtgtaattaaatttaccatgctttaaaaagaattcttaatttgaaaaataaagcagcaaggaaatgaaatatgatgaaggaattgtcaccataatttggggcattcttctcaaactggagtacatgacattgtgtcaagggatacctataaggcttagaatctaagccacaggaacaaacataataattttttaagtaccaattttacttgatggtattaatttaaataactttaatattaagataagcataagtaaattaggcacaaagtatagaattcatatgaggctttaagatgaaattagaaacttcaaagaaatttcaagtgagcccattatatttcaagtgagctccagatctcgtcattcttctgcgttattgacacttcatggcaaaaaatttaaggagcactgaatcatagaaagaacactgtaagaactatgttctcatactattctggctagtaaagttttgtaaccttcagtatattgtgtaaccctctctcagcttttcttaccactaaaatgaagaaatcactctctaagatcacttcaaggctctcatggcagtatatgtttctatcttttagcattctgaccagcaggaaagagaaatataggatattagacctagttaatttttttctgtctttataatgggaatgattataggggagggtaggttatacataaaaatgcaagagaataagaaatagaataatgatcaaagaaggaaaatatttagattttttatttagaaatttttgtgacattaatctttctgttattagcaatcttacacttaggtttcagacacagctcaggactgactttgtcaataaaatatttcctaggaattattctcttcaatgatgtctttctttgttttccttacaacgtttataaatgttgtctataccctgtaatctatatgtgggaggctgcatggtgtagcttaaaaaggatagaactttggagtcagatagacttggacttcagaccctcatttgccctttattttgggaagtcatttcacctctctgaatttcagttttcttctccgaaatgaagatggcaatatctactttacaaagttttcagaactaatagaggtaacgcatatgaaaatgcctagcattttcagatgagatactcagttatttttggttccttcctctttgtatgttgctttgggagcaacttgccacagtttcgtgtatacatgtcttattcaaagtagattttaaagttcttgagatatatggttatgttctttacttcttttgtgcccttttgtcatagcatctgttaatgaagtaattggatagaaggtgtttaataaaaaaattgggtggtgtaaaatttatatagtaccttaagaaacatttaggtaaaccagaacttggctattattactaaaaggatagtttagggtagatggagtgaagttgattagtttttaaaaggtatgtttttctggtaataggatgatatttataacgatgtgtgtttgagatgttttatagcattaaattttgtatattgttttagttgggtgttgtttgtgtgaggataattttagactaatgaaatttgatatctaaaaactaaaaatttgaaattataggtaaaaaaattctgaaaatgctgttaatgttgattctggtgatcaaaataacactgttaggagtcaaaagttatgcctcttctcccactttcaagataagcacattttaccacagtttccttacctttaaatgggggtaagtgtgtttaccttgatgggttaatgtgagaaatgaaataatgtattcagtattcaacacctactatgtaccaaggccctgtgctaagtgaaggatacaatagtgattaagacagttcaatctttcttgtcttgaagcatatattctagcactactgtgaaaacattattcagtcaagttgaatattgacacattcatgcttcatttatgtttcaaggaataaggtgcttttatattttattttttaagtagataacaagtacaagcaccaaaactgtttttatgtcaagccatttttttgatacacatttttttttttttgagacggactcactctgtcgcccaggctggaatgcagtggtgcgatctcagcttgctgcaacctctgcctcccgggttcaagtgattctcctgcctcagcctcccgagtagctgggattacaggcgcctgccaccatgcctggctaattttttttttttttttgtatttttagtagagacagagttttaccatgttggccaggctggttttggactcctgacctcaagtgatctacctgccttagcctcccaaagtgctgggattacagatgtgagccaccgtgcctggccagcaattatatttctacattctattctgaatatctgttactgtgacatgatagtatgtttccataacgtatatgcttttcaggttttacccacttgcccttcctcttcctgccctgcccttctaatctactatatccttgggaaccacataaacttgctaagaattatttgtgatattacatccagttagatttgaagtgagggtctaaaggcacatattttcacttttgggttcagggcatcagaaaatgagtggatattactataataaatagctttatttctttgtatagtacttcacgatttcaggatcatggctaaatgtgtctgcctgatgctgtaaatgttaataaaaatccactctatgagtgaaagagattaagtgcaatttgaatgctaagtaaaaatgaaatgtttcttttaattatttcttgttcttttaaaaaacacattaatgtgcacttgaaattaataatctttaaagtctaattaatggttaagaactgttggatatcttataaataagaaactgagccaggcacaggggctcacgcctgtaatcccagcactttgggaggctgaggcgggcagatcacgaagtcaggagattgagaccatcctggccaacatggtgaaaccccacctctactaaaaatatgaaaattaggcaggcatggtggtgtgtgcctgtaatcccagctactcgggagtgaggcaggagaatcacttgaacccctgaggcagagattgtagtgagccaagactgtgccactgtactccagcctggccacacagtgagactccatctcaaaaaaaaaaaaaaaaaaaaaaaaaagaagaaactgaatagagtaaaaatactattttcagatgtaaaaagatgaaggaacatttacacggtggtgcccccctcttcactttcacctaagagtctatacagaacattttgattatagtctaaactttaaaaattatgctttcataaaattaacatccacattgtagaagttacgtttggattaaactgcaagtgggcactacccaaagcaatctacagattcaatgcagtcctatcaatgacattctataccaatgacattcttcacagaaatagggaaaaaaaagttaaaatttgtatggaaccataaaggacctggaatagccaaagcaatcctgaacaaaaaggacaaagctggagacatcatactatcagactttaaaatatactacagagtgatagtaaccaaaacagcatggtactggtgtaaaaacagacacatagaccaaaggaacagaatcgagaacccagaaattaatcctcatatctacagccaactgagttttgagaaaggtcccaggaacatttgctgatgaaaggacagtatcttcaagaaatgtttctgggaaaaaggatatccatatgcagaagaatgaaactagagccccacctcttattctgtacaaaaattaactcaaaatgaatcaaagacctacatgtaagacaggaaactatggaactgctagaagaaaacataggggaaatgtttcaggacattggtctgggaaaaaattttataaataagacctcaaaagcacaggcaaaaaaagcaaaaataaacaagtggattatagtaaactaaaaagcttttatacagcaaaggaaataaccaacagaatgaaaggcagcctatagaatgggagaaaatatttgcaaactgttcatctgacgggggattaatatctaggatatacaagaaactcaaacatcttaacagccaaataaataaataaataaataaataaataacccagaaaaaaacaaaacaaaaaaaaccctgcaaaaaatgcaatctgattaaaaaaagatgggatatttctcaaaagaagacatacaaatggccaaaaaatacattaaacaatgttcagcatcattaatcatcaggaaaatgcaaatcaaaaccacagtgaggtattctcttaccccagttaggatcactgttatcaaaaagacaaagaatgacaaatgctgccaaggatgtagagaaaagggacctcttatatactgttaataggaatgtaaacaagtacagccactatggagaacagtatagaggttctttaaaggactacagatagaactaccatatgatccatcaatttcaccactcggcacttacccaaagaaaaggaaatcagtatatggaagagacacgtgtaccatatttactgcagcactgttcacaatagctaagatatagactcaatctaggtgtccaacagcagattaatgggcaaagaaattatggtatatatgcataatggaatactgttcagccataaagaatgaaatcctatcattcatggcaacatggatggaactgaaggacattatattaagtgaaataagccaggaatggaaagttaaacactgcatgtcctcactattatgtggaaactaaaaaaagttggtttcatagaagtaaagtagaacagaggatactagagactgggaagaggcgggggaaggggatacagggagaaatgtgttataggatacaaaattacagctagattggagaaataaattctagtcttctgtagcattgtagggtgactatagttaacagtaatatatagtttcaaatagctagaaggaggatattgaatgttctcaacacaaagaaatgataaatgttcaagatgatggatatattaattatctaatctgatcaccatacattatatgtatggagacatcactatgtatctcataagtatgtataattattgtatgtcaatgtaaaatataaaagaaaattttaaaaattgcaaataagaaagctcctgaattcttatgtcattcttttaattagttaaatttattaaagtatatttatgtgttataaagaatgtaataatacagaaaggtaaaatgcgaaattaagcctcatcacattacttctctagtttctctctagtgttaaccacttaaaaaatctttttgtttattcttttgtatacagtcatatatttgatatatttgaatatgtgtatgtgtatcatacaatacatcagagcttgcaaattgatggaccactggccctaactaaccagtgtttcattagtcccctactgtattttagaaaaagtatttgtttctaacacttaaaaaaagatatttcatataaaatccatattttttttgcttcttaagattcagcaacacacaacatgtttctcacataatagttgtttagagttactgtctgcataagatagaacatgcgttcttcagtttcccacagtttctgtttaatacgtgttggctgcctgaccttgataggcatttgagattgtgattcttgctcatacatagtattttgcactttcttccttcactccctaactctgtagcatattttggacatcttttcatattagtgaaaataatagtggttaactttattgagagcctatgaagtgtaaaatactttctagagcctgttacagagcctattcatttaatcctcgtaataatatgttagtgttgtcaccattttacagctgaagaaattgtagcagagagagattaagtaacttgctcaagttagtgcagtaaatgaacaggctgcaaattgaatctatgtaatctgtccgtagagtgtaagctcttaactactacatgatactcctctttggcatgtcagaattatttcatagagatcttcaaagatgttcatatacatatttcactttaatgggtcttactgcattgtaggttatgctatatttaattagtccctaattgatggacatcgaggtttctgatttttcagagacagatgttgtagataataatattatacatttatcattacaagtttataagttttttataatgtaagattactatctgtagaattttggggtcaagggtatatgaacttaaaaattttaatagataatttactttccaataaggatgtattaattaatattcccaccttcattgggtattagctttttagctttacaagttcttttgaatatacttcttgagttacacaggatccttttattaggattctttattgcaaatgagagttactgagctcaaaattagcttaagtgaagagggaaacttacatagccatagattacagaggaggagctgacttaagggactcaaataatgtgatcgggaagaaatgtaatcatgaactcttactctccatttcagtgctctgttttctgagtatgttgcaggctgactttcttcttatagtcagaattgtgaggttatagaggaggggtagattgagaagttatagtaatagtttcatgtttccccttcccaattagtgagtccagaggaaatattttctttttttttttaaacttttattttagtttcaagggtacatgtgcaggtttgttatataggtaaactcatgtcagaggggttgttttacagattatttcatcacctagctactaagcctggtacccaatagttatttttcctgcttatccctcttcccaccccctaccctcaagcaggccccagtgtctgtcgttcccttctttgtgtccatgagttcttttagcccccacttataagtgagaacatctggtatttggttttctgttcctacattagtttgctgaggataatgacctccagctccatccatgttcccacaaaagacatgatctcattttttttatggctgcatagtattccatgatgtatgtatacaaaccacattttctttatccagtttgccattggtgggcatttaggttgattccatgtctttgctattatgaatagtgctacagtgaacattcatgtgtatgtgtctttatggtagaatgatttctatttctctgggtatatacccagtaatggaattgctgggttaaatggtggtcagaggaaattttttttttctcgtgacatttgtatataaacttccaggatgctcacctggcatgactcacatgtcaattttggagcccgtcattgtaaccaggaggttgaggcttgattggccaggtctgtatcacatatccatccttgggagtggggatactaaataggtaacctcaccagaatcacatagagagagtatcttagtgtgggctgctatagcaaaatacttagactgggtaatttataaataacagaaatttatttcttacagttctggaggccgggaagtcaaagatcaaggcactagcagatctggtctggtgagggcctgttcctcagggacaatgccttcttaactgtggctttctagctatgtccacatatgttggaagggcaagagggctccctcaagcctcttttatgagggcactaatcccatttatgagggtggaccccttgtgacctaatctcctccaaaggttctacttctttaagaccatcacagggtggggtgggatagggggtctggtttcaacattttggagggggacgcacacattcagaccacagcagagggaacaagggaagtctttaaaaggagaggagtttctgtcactaaaaggggaaaagtgtgctgagcaagcagacaactttttttttagagggtccctgaagtcttgatgcctttttgcttcattctttttttccctgagaatgtagttcattatatcagtcactgtttcttctttctcctgcttctgccatgaaaatgctcctctggcagatagtttcaaattggaattggaataagttagggtgtggcaatcaatggcttaaacctaggcccctgtgatgtgaagggtggttaatttgtatatcaggagaactcacaatgattgacctccactttttcatactctatataaaagagtggttctctaaagacattttagaatagtaatacacacataattgaaatattttacccattttttaaagagccctttatgttgctttattttgaatttatgatcacctatgggtcttagtctttttttctacaaatggtgcctcccagtgtttcctaaattttgttctagcaacacttgtccgggagatgttatagtatgtattatatgaaaatgcttttacatgatcaaataaatgtggaaagtgccatataatgcatccctccatttggagattcacagtatatgaaggcatattaaagatgtgagtaataattgtggaacctcttaacctgtatttagtctagtgcttccaaatttatttgaaaattaaacactttttcaagatacacctgagttctgttcaacacctttttaggaaatggtggtctttcccctgcagatgatctcttgaaaatctgtgtatgatttttatatgtattcttttactttttttgctgtaaaaataatggtttttctacaataatctttattgtgaaaattaattattttaccctggatttacctttaaaatatataatttttttttctaatcaccacctctttttttgtttgtccttttttttcctgttaaaatgttgactgaatatattcttatttgattctgaaaatctatgatagcaaagactagaaactgaccagtcttggttctgttaccactatgtggggaaagaacactggatgaaattctattttggattttttcagtgggagtttagtatcattatttgtaaaatggaaagttgagtagatgatctctaaaatccccttcagctctaaaattttattaatcctaaatctgaggaacatgcctcatgtttaccattccatcattgctgaaatctattagtgacggcaaaattattgatctaaagtgttttccttcaaacaggaaaaattactagaaaaagacacagacattcataacaagtgtaaatgaaaataaatgtctgttacttccactgcacaatatgtgcaattttatttcattcaatatcatgtgctacagaggttcaaattgctaaatatatagaccttagaaaaaattatatgaacttaagtgtaatgacagattcccacaatcaagcttagaagaataatagtgattaaggggtatttgaagtattactttttctttttaaatttaaaatgtattgctacactagagatctggaaaacaaaaaattagcactccctccaaaatagttattattttgctattgtaaatttaaaataaagctgttgtaaaataagacataatacctttgatgaacaatattatgttttaggttcacacagatactcagaatagtaggtgggctctggattagaccacctgggtttatacctaagtgaagtttttagagttacttctctaagctttagtttttttcatctgtcaaatggaaaataatactaatatgcctgccttagagggttgttgtggtaagtgagataatgaagtaaacctttaatgagtgtgcccacatactaaatattcatgaaatgtttgttgtgtattataatacatttgaatataattaccttaataaacagggcaacagaagcaacctgtacaacttttgggtatctgacctcaatcttggtgtatccccatgcccttttcccactattttatcttattttagcaacatcattaaggttcaatactgaactggggttctgcttgatctaaattcttgtcttccagcttaagttttgggcagttagagttagaagatgctatttgtagtgtagtaactaacagcaagaatttgagatttttgagatataggtttaaagtaaagtatgtatggaagactgcctctgatagtctctaaggcttgttaagacctgtggagaaaattcacatacatatatgtgggtactatggttatggaatactaagtgttctagttaaaaagttaaagtaccctagttaaaaaggtgtttttaaagtttgaaatattatgcaactggggcagtaatgcagggtggtaaagtgatagtaaaataaaatatttatatagatgattgttgatttgtagtagaggaactttaaattagtagatgaggaccttatatgtttgaggttaaataaacaatgatttggggcataagggaaataaatattatgtataaaagggaaaagatacttttagaactatcagatgctaaaagagaatctatcaaatttagagcattgccaaagataagttttggtagaaaagtttgggaatcattaatttagttttttaaaaaattattattatactttaagttctggggtacctgtgcagaacatgcaggtttgttacataggtatacacgtgccatggtggtttgctgtacccatcaacctgtcatctacattaggtatttctcctaatgctatccctcccgcagccccccacaccccgacaggccccagtgtatgatgttcccctccttgtgtccatgtgttctcattcttcaactcccacttatgagtgagaacatgtggtgtttggttttctgttctcgtgttagtttgctgagaatgatggtttccagcttcatcgatgtccctgcaaaggacctgaactcatcctttttttatggctgcatcatattctaccgtgtatatgtgccaacttctctttatccagtctatcattgatgggcatttgggttggttccaagtctttgctattgtgaacagtgccgcagtaaacatacctgtgcatgtgtctttacagtagaatgatttataatcctttgggtatatactcagtaataggattgctgggtcacgtggtatttctggttctagatccttgaggaatcaccacagtgtcttccctaatgattgaactaatttacactcccaagagtgtaaaagcgtgcctatttctctacatcctctccagcatctgttgtttcctgactttttaatgatcaccattctaactggcgtgagatggtatcacattgtggttttgatttgcatttctgtaatgaccagtgatgatgagctttttttcatatgtgtgttggctgcataaatgtcttcttttgagaagtgtctgttcatatccttcacccactttttggtggggttgtttttttcttgtaaatttgtttaagttctttgtagattctggatattagccctttgtcagatgagtagattgcaaaaactttctcccattctgtaggttgcctgttcactctgatggtagtttcttttgctgtgcagatgctctttagtttaattagatcccatttgtcaattttggcttttgttgccattgcttttggtgttttagacatgaagtctttgcccatgcctatgtcctgaatggtattgcctaggttttcttctagggtttttatggttttaggtcttacatttaagtatttaatctgtcttgagttaatttttgtgtaaggtgtaaggaaggggtccagtttcacttttatgcatatgggtagccagttttacgaacaccatttattaaatcctttccccatttcttgtttttgtcaggtttgtcaaaaataaaatggttgtagatgtgtgatgttatttctgaggcctctgttctgttccatcggtttatatatctgttttggtacctgtaccacgctggtttggttactgtagccttgtagtatagtttgaagtcagttagcatgatgcctccagctttgttctttttgcttaggattgtcttggctatgtgggctctttttggttccatatgaaatttaaagtagtttttttttttttaattctgtaaagaaagtcaatggtagcttgatgaggatagcattgaatctataaattactttgggcagcatggctcaccatactgattctccctatccattagcatggaatgtttttccatttcattgtgtcctctcttatttccttgagcagtggtttgtagttctccttaaagaggtccttcacatccgttgtaagttgtattcctaggtattttattctctttgtatcacttgtgaatgggagttcactcatgatttggttgtttgtctgttaatggtgtataggaatgtttgtgatttttgcacattgattttgtatcctgagagtttgctgaagttgcttatcagcttaaggagattttgggctgagacgatggggttttctaaatatacaatcatgttatctgcaaacagagacaatttgacttcctcttcctatttgaatacactttattgctttctcttgcctgattgccctggccagaactttcaatactatgttgaataggagtgtgagagagtgcatccttgtcttgtgctggttttcaaagggaatgcttctggtttttgcccattcagtatgatgttggctgtgggtttgtcataaatagctcttattattttgagatacattccatcaatacctagtttattagtttttagcatgaaggggtgttgaattttgtcgaaggccttttctgcatctactgagataatcatgtggtttttgtcattgcttcggttttgtggtagattacatttattgatttgtatatgttgaaccagcattgcatcccagggatgaagctgacttgatcatggtggaaaagctttctgatgtgctattggattcggtttgccaatattttatcgaggatttttgcactgatgttcatcagggatattggcctgaaattttctttttttgttgtgtctctgccaggttttggtatcaggatgatactgtcctcataaaatgagttagggaggattccctctttttctattgtttgcagtagttccaaaaggaatggtaccagctcctctttgtacttctggtagaattcagctgtgaatccttctggtcctggactttttttggttagtaggctattactgcctcaatttcagaacttgttactggtctattcaggaattccacttctttctggtttagacttgggaaagtgtatgtgtccaggaatttattagtttcttctagattttctagtttatttgcatagaggcgtttatagtattctctgatggtagtttgtatttctgtgggatcagtggtaatatcccctttatcccctatttgattcttctctcttttcttctttattagtctggctagtgttttatctattttgttgatcttttcaaaaaaaaaaaaacagctcctggattcattaatttttttgaggagattttcatgtctgtatctccttcagttctgcgctgaccttagttatttcgtgtcttctgctagcttttaaaattgtttgctctttcttctctagttcttttaattgtgatgttagggtatcgattttatatctttcctgctttctcttgtgggcctttggtgctataaattttgctctaaacaatgctttagctgtgtcccagagattctggtacgttgtgtctttgttctcattggtttcaaggaacttatttatttctgccttaatttcattatttacccagtagtcattcaggggcaggttgttcagtttccatgtagttgtgtggttttgagtgagtttcttaatcctgagttctaatttgattgcactgtggtctgaagactgtttgttatgatttccattcttttgcatttactgaggagtgttttacttccaattatatggtcaattttagagtaagtgtgatgtggtcctgagaagaatgtatattctgttggtttggggtggagagttctgaagatgtctattaggtctgcttggtccagagctgagttcaagtcctgaataaccttgttaattttctgtctcgttgatctgtctaatattgacagtggggtgttaaagtctcccactattattgtgtgggagtctaagtctctgtaggtctctatgaacttgcattatgaatctgggtgctccagtattgggtgcatatatatttaggatagttagctcttcttttgcattgatccctttaccattatgtaatgtccttctttgtctcttttgatctttgttggcttaaagtctgttttatcagaaactaggattgccacttctgctttttttgctttccatttgctgtgtaaatattccttcatccctttatttttagcctatgtgtgtctttgcatgtgagatgggtctcctgaatacagcacaccaatgggtcttgactctttatccaatgtggcagtctgtgtcttttaattggggcatttagcccatttacctttaaggtaaatattgttatgtgtgaatctgatcctgtcattatgatactagctggttattttgaccgttagttgatgcagcttcttcatagtgacgatggtttttacaatttggtgtgtttttgcagtggctggtactggttgttcctttccatgtttagtacttccttcaggagctcttgtaaggcaggcctcgtggtgacagaatctcagcatttgcgtgtctgtaaaggattttatttctccttcacttgtgaagcttagtttggctggatatgtggtaattctgggtttaaaattcttttctgtaagagtgtagactattggcccccactgtcttctggcttgtatgatttctgccgagagatctgctgttagtctgatggccttcctttgtggataacccgacctttctctctggctgccattaacattttttccttcatttcaacctcagtgaatctgtcgattatgtgtcttggggttgctcttctcaagtagtatctttgtggtgttctctgtatttcctgaatttgaatgttggcctgtcttgctaggttgaggaagttctcctggataatatcctgaagaatgttttccaactttgttccattctccccatcactttcatgtacaccaatcaaacgtaggtttggtctttgttaacatagtcccatatttcttggaggctttgtttgttccttttcatttttttttctaatcttgtcttcatgttttatttcattaagttgatgttcaatctctgatatcatttcttctgcttgatcaattcggctgttgatacttgtgtatgcttcacaaagttcttgtgctgtgtttttctgctccatcaggtcatttatgttcttctctaaactggttattctagttagcaatttgtctaaccttatttcaaggttcttagcttcttgcatttggttagaacatgctccttcagctcggaggagttcattactacccactttctgaagcctacttttgtcaattcattagactcattatccgtccagttttgttcccttgctggcgaggagttgtgatcctttggaggagaagagacgttctggtttttggaattttcagcatttttgtgctggtttctccctatctttgtggatttatctacctttgttctttgattttggtgacattcagaaggggtctgtgagtggacgtcctttttgttaatgttgatgctatccctttctgtttgttagttttccttctaacactcaggcctctctgctgaaggtctgctctagtttgctggaggtccactccagaccctctttgcataggtatcaccagtggaggctgcagaatggtaaagattgctacctgttccttcctctggaagcttcatcccagaggggcacctgccagatgccagccagagctctcctgtatgaggtgtctgtcgacccctgctgggaggcatgggggtcagggacccacttgaggccgtctgtcccttagcagagctcaagcactgtgctgggggatctgctcctgtcttcagagctggcaggcagggacgtttaagtctgctgaagctgtgctcacagccaccccttcccctaggtactctgtcccagggcgatggaggttttatctataagcccctgactggggctcccacctttttttcagagatgccctgcccagagtggaggattctagagaggcagtctggctacagcggcttggctgagctgcagagggttccgacgggttggaacttccctgggctttgtttacaccgtgaggggaaaactgcctactcaagcctcagtaatggtggacgtccctccttgcaccaagctggagtgtccctggtcaacttcagactgctgtgctggcagggagaatttcaagccagtcgatcttagcttgctgggctccttgggggtgggttcccctgagctagaccacttggctccctggcttaagccccctttccgggggagtgaatggctctgtcttgctggtgttccaggtaccactggggtatgaaaaaaaaacaaaacaaaaacctcctgcagctagctcgctgtctgtccaaacgaccactcagttttctgttgaaacccagggccctggtggcacaggcaccagagggaatctcctggtctatgggttgtgaagaccaagggagtgtacggtctactgagcctgagtgcacagttccttacagcacagtccctcagggcttcccttggctacggatgggaattccctgaccctttgtgcttcctgggtgaggcaatgccccaccctgcttctgctcgccctctgtgggctgcaaccactgtctaaccagtcccaatgagatgagccaggtacctcagttggaaacacacaaatcacctgccttctgcgttgatctcgctgggagctgcagatcgaagctgttcctattcggccatcttgccagcaactcagcccactgttttcttgtttgtttgttagattttttttttttttttttttgatacggagtctctctctgttccccagactggagtgcagtggtgctatctcagctcactgcagcctccgcctcccaggttcaagtaattctcttcccaaatagctgggattacaggcacctgccaccatacctggctgagttttgtacttttagtagagaaagggcttcgtcatgttggccaggctggtctttaattcctgacctcaggtgatccacccgccttagccccccaaagtgctgggattacaggcatgagacaccatgcttggccaaatttaggtttatactggacttggattttcaaattttcttttgcaggtgagtttgtgaagtgttaattttaaaaaattgccaggagtctgaggcaggagaatcacttgaacctgggaggcggaggttgcagtgagccaagatcacaccattgcactccagcctgggctacaagagttaaactccctctcaaaacaaacaaacaaaaaaattgtcaattatgcatcacaatgaaacattcatttctgatttttagcacaattcaggagtaggtcatataatacatgacaaactcaaagatgaataatgcagtcttcccaaatagtagaaacttttaagcagctgaatggtaatggatctaattttgttattttattgtttttctgtctatgagtgatatattggtctgaccatagcctgacttgttaacaaacaatacagctcaactcaatatgtagtgtatcatgtactttgcatggtgttaggctaaaactactaagtatttataatgttatgctttaagtatgattagttgattgtaaaatggttcacattttaaggtatttttatattgaaacccttgccaagtactgtatgacagggttttcaaaacttttttagtaaaagactagatagtgaatttttaggctttgtgagctgtatatgatttctctcacaactattcagctctgcccttgtagcatgaaagcagctgtagacagtgtataaatgaatgagcattatagtgtcccaccgaaattttagttataaaaagaaatggcaggccagaattggtctaagggctgtagtttgccaactcctactcaagacgtagcctgttgtaagggaaatataattccaagttacctgcatgtgaatcgaacttttatattagttaacatttgcattacaaaacatcacaaaatttagttacttgaaactacgatttagtatttttcacatttctgtgaactaatttggttctgcttccggtggcatttgttggggttctgatagagctgtgatatctggaggctcaactgggattgttggccagggctttggttctcctacatgtgggtctttctatatggctgattccttagcctcatggtgtgatagttgggttataagaagtattctaagagcaagcattgtgagacagaggaagcagaagatgccaggccaagggataggcctgaaactttcacagcatcacttctgccattattctgttggtcaaatagtcacaggctcagcccagagtctttgtgggaagagactacccaagggtgtaaatgctaggaagcatggttaattgaggatattcaaactatcctcagtatatcatgagattgttttggttgcaagtgacaactcaaattgaactagctttagtaaaagggaacaattattataagaatattggggtgtctgcctcacaaaacccaaacacaagattgggtcctaggaacattggacccagggttgaagattcccgaggactgtttctcatctttgctctaccctgtaagtagtcttcattttctcttatcacaaacttcccttctccactttgggaaaaacagtgtcaacacttccctaattatttacatattaccattttagccattcagaggactgactttatttttgcagtgtttctaaaatgtttgaggaagaatgctgattgtcctagatcagtcatctgtgatcagaggatagagcttaggttctacaaaccatgttggcaggaacaggatcagttaacatcaaagggatgctgagtgtgtagtcgccgaatagtcagtccacttgccttctccctagccatctatttgttaacaagttaataatttgttaattaataaatgtttttttccccattacaggcctaatttacttctttattcagctctctgcctatggctatttcattgttctactggtgtgtaagcaaaagtaagaactgaaattaattcagtatcttgaatatttattgtaatctcttcctgctttgagtagaggatggcagcttttagtatctgctatcttactttgccaccataaacatagaatagtatgtaaagatgatcttactctgttgccaccattgatttccaggtttgacttagctgatctggttggctgaatgggtatatccttcctttggaaagggaccacgtgcatacatgaaagcaagtagctaaaatacagaatgaaataaaagctgtaatagaagtacaagcaacatgccgtgggtgcacagaggaaggaacaattaattttgactgaatggctgtaggagggatggcattttaaggaaggtagtgtttcagtaaggcctggaagaatgaataacttatccttagaaaagaaagggaaggtaatctggctgtcaagtttctcatctgctgaaacggtggtaccagagtgtctaggctaaagtagatgaacttaaatataggtataggacattcaggataaatggcagcatgcagttgtctgattttagccatcttaaattggaattacaggagtgaacacagttttgttacagttacgccttaggtgactatctggtaatttgaaatttgagacttcagtttttaaaattaagcagtttatttcaaatactcagatttttggatataggaagaaatttaaggattatctatactaacacactctagtaggtaaagaaactaagacctagttagatgatttatttgagcttacgtatctaaatgactgagttggggctaaaatacctttctcctggtcttgggtatttttgaagaattatccagtgtatcctttattgtaagaagattttctccaagtatacatccatatgaattgcttgctgtagtagcaatttttaaatttgagatataacatgcatatagtaaaatgtacagatgttaattgtatagcatggtgagttttttatgtgtacaaactcttacaattaacactcagatcaagatgtagaacatctccagcactccagaagcctctccttcatggttttcacaggttaactaatatccacttctcctgtcactcccaagtaattattattctgatttttattatcatagattagtctttcctgttcttgcacttcatgtaaagggaatgacttctttcgtttattatggttatgacattcatccatgatgttggtataccttggttctttttattgctatgtagtgtttcattgaatgaatggatcattatttattcttctgttaatggacatttgaattgtttctaatttttgacttacaaagaaaacctgctatgaatattctcgtgtatttctttttatgaatatattgtttcatttttaagagtataattgttggatggttgtcttccaaagtggctgtaccattttacatccccaccagcaatgtaggagggtttgagtagttctacatttttgtcaatattgtgtattgtcagtctttttaatttcagtcattctggtcagtgtgcactggcttctccttttcatttcccaggcaaataatgatggtgatcaccttttaatattaatttttgacatattttaaagttattctgtctttgtcttatggatttataggaattccttatgtattctgaatatgagacctttgcatggcaaatttcttctcccagtctgaggctagtcatttcactctcttaatagtgtattataataaataaaagttttcaattctaatgaaccttaacttatcaagtttgctttttatggtttagttggtttgttaatgttttgtttaagaaatctttgcctattacaggatcatgaaaatattctccaaagttttctttttgaaattgtattactttcttttttactcaaagctctatgatgcatttcaaattatcttataatgaatgatgtgaggtaaaaaccaggaatttttaaaataaaacataggatattcaattgatttggccccattttttgaaaaaaaaattgcccttaaaccattggattatagaacacttttgatataaatcaggtgagtcttactagagtgtatatgctcttccactggtctatttatgtacaaatactaccctgtcttaattactgtagctctatactaaatcttggtatctggtggtataagttccttcaattttatttcttcttcaacatttttttttgtggtgggtatactctatcctttgtgtttccatatacatttagaatcatatttcagtgaaaacaaaactgttaatattatgattgggattgcattgaggctatagatcaatgtggggagaattggcatcttaacaatatagagtcttctagtccatgaacatggattatctatccatttacttgggtctttaagttctttcagcagtattttttggtttacaatgtagaggtttcgcatatcatttgttagcgttatggctagctattttaatgttttgaaagtgctattgtaaatggtattcgttatttaaatttcattttgaattgtttaatacatagaattacagttgtatttttatcttataagcagcaacccgctaaatttgcttatttttaatatttaatattttatagattttttgtatttcctatgcaaacaaccaaatcatctgagaatagtaactattttacttatttctttccagtctttataattgtttctttgttttcccttattgcaatggccaaggcttctagaacaatgtttaattgaaatagtctcactcctaaacttaggggaaaatgttcaatatttaccaattatgatgttagttgtaagttttataggtaacctttatcagattaaagaagttcttatctattcctagttttcttttcttttttgaaaaaaattttatagagagagggccttgctctgttgcccagactggccttgaactcctggctcaaatgatattcccacctcggcctcccaaagtgctgggattacaggtgtgagccactgcgcccagtctgatagttttctaaatcatgaataggtggtaaactttgtcaaattttttgcttttgttgagataaatcatatggttgtatccttaattctgtgatgtggtgaattacattgattgatttttaaatgttaaaccaactttatactcctaggataaacgttactttgtcataatgtattgtcccttttatgtaccattagattcaatttgttaatattctctttagaatttttacatctattcatgaaagatattggcctgtaatagtcctttattataatatttttgtcagattttgttatcaatgtttgttagccttgtaaaaagaattgggaagtctctctctgttttatttcaaagtgtttgtgatagattgatacgtttcatgtgtacttgaattgggaagtctctctcttttttattctctgaaagcatttgtgattgatagattcatacacttcatgtgtacttgaatgttgattctgcagtctttggtgttaatgttctttgtcagtaaggtcatattggttaatcaagttgttcaaatcttcaaatgactgatttcttttttcctgttctctcagttttgagagtagtgtcttaaaattataaactatgactgtagttttgttgacttttagttctttcagttttcccctcatgtagttggaagctcttactaggtgaattaaaacttggcattgttattttacggttgaaatgacctttttgtcattatgaaatgaccttctttatctctggtaatatttcttgccttcaagtctacttttaccttctattaatatagtcactctttcttttcatcaatacttccatggtatgattttttcttctttttagttcagccaatctatattcttgtatttacagtatatctcttggaaatgtcatatagtcaggtcatgtttgttttatctagtttgacaatctttgtgctttagttgtaataggtattctatttacatttaatgtggttactagtatagttgggcataaatcttttatcttactgtttcttttctatttgtcccatccatactttgggtgtttaaatttctttcctgcctgtattatttgtcaggttttctaaactccattttggctcattagcttttcagttatacattcttctgtggttattttttagttatcttagagattttaataaatcttgattttttttagtgtatcttaatgttttaccacttcccaaacaatgcaaaacttaggacagtttaactttgtttattccctcctgccctttgtgctatttttttcatattttatttcaatatatgatacaaaccacataatttttttgtaaacagttaatattcttttatatttatccacatgtgtaccctttctaatgctcataattcatttttacagttctttgctaccatccaggataattttcctttagcctgaaaaaattcctttaatatttcttgtagtgccagtctctttgaggcagattttctcagcttttgtctgaaatccctttattttgacttcttttttgaaggaaaaacttattggtacagaattctgggctggcatgtgttgctgttttgagacagggtctcgctctgttactgaggctggagtgcagtggtgtgatcatagctcactgcagcctctaactcctaggctcgagcgatcctcctaccttatcctctcaagtagctgggagtacaggtggcaccactgtgctcagctaaattttttgttttaggttttgtagagatggggtctcactatgttgaccaggctggtctcaaactcctggcctcaagctatcttcctgcctcagcctcccaaagtgttgggattacaggtgtgagccaccatgtccagcctgaatcttttattcttatagcacttcagatatgtaattcctttgtttttccttattgttgctcctttaaggagtgtgcgtttttttggctgcatttaagatttttatttttgtctttagttcattaatagtttgtatggtgcctaggcatgggtttctttgcatttatcatgtttggggtttgctgggttaatggttttttttttatcagccttggaaaaatttgtattttatatctttatattttgcttctaccccaatctctctctcctctaaactgtgttaggcgttttgactgtcccacatgtctcatgtggttattctgtcttttctctctgtggttcaattttgtattttttgttgagctattttttaaacttacaatttctctcctcttctgtgccaggttgaataacctatccaataagttttaatagcttattttctcagctctaggaagttttattatttttaaataggtttccttttttgttgattatctccatccttttataaattttattcattttttttccttccctttcattagcctatggataatggctattttaaagccattgtctcctaactccactatcagtgtcatctctagctttgcttttagtcttgattacaggtcattttttcttgttttttttttttcacatatattgtatgtgaaaaacatacaatatatgttttgaaatacaatatatgaaattaataaatttcacatttattatatgctgaaacttgtaataatttatgtagaggctgaaggtgatatcttccaccagagatgattcccctttttagttgttaggccaatttaattagagttttattagggtcagtctgcattgcagttttagtaagatttagtctatctctggtttgtctccattgacatactcagatttttgattgaaagactgtcagatttcttctccacagccctgaaagactgcaggagatctaattctgttctttagaggttttgagattagcccggtaatctcttggtttatttacagtgctttaaattcatgcaaatgtgggaggtctgtcatgtgttttttgcggtttgtcccctgtttctaggaaggctttttttctggtaagcactgtaatactgagggagatttcactctgcccttctagcacgtctcccagcctccttcattacttagaattcagcaaatgttcctttcaaccttgcatttggggctttctagttttcagactactgcatgaaaaagctcagctgctttctactttcttttttttttttttttttttttgagacagagtttcgctcttgttgcccaggctggagtgcaatggcgtgatctcggctcactgcaacctccgcctcccgggttcaagcgattctcctgcctcaggttcctgagtagctgggattacagccatgtgccactatggctggctaattttgtatttttggtagagacgggtgttggtcaggcttcgtgttggtcaggctggtttcgaactcctgacctcaggtgatctgctcacctcggcctcccaaagtgctgggattacaggtgtgagccaccacgcccagcctgctttctactttcaccagtggagtctttctgtctgggccaatctcagttctcagtctctgtccagaattttcaaatgctcccaggaaataaaataggagatggttatctgcacacctaggaagggctcttctctttctagaatttcagttcatctacttcttgttctttcataagcactctggtgtcttaaaaattggattgaaattcatctttttctagttgttgaagcattaaaataactgctgtccttaaagtttgaaacagcaaaatctatttgtttttctgattataaaagtaatacacaatgtattgtgtacttctgctaagttatgctgcataacaaatgacctctatttcagcagctcacaacaacaattgcttatttttgctcttgcttcatgttggctgaaggttggcagtggctctgctcgtgctccacatatcttctaattctgagatccaggctagagaacaacttctatttgggccatgctgttcttgtaacagagggaaaaaagaaaatgatttggcaggaatacacagtggctcttaaaacttctgcttggatgtttgtttatataccattggccaaagcaaaccagtggccaaggccaaagtcagtggagcagggatgttactcttatgggagtgctgtcagttacataggaacaggtgtggatgatgctccttttgaaggaaagtggagtgaataattacaaattgtgatagaatccaccacacatgctaattgaaaataaattaaatagagatgtataatgtttatagtagaattcttccttctgtcttccgtgataatcagtgatgatactttggtgtatgttcaggactgaaaccttcttattgtgctaacttgatggtttctttaaaaataatagtcttgacataaattatgaataagacttgtttttttagccatatactcagaagaacactagagttctccaactggctacgcttagttcttgctttgccaggtagtcccacgcttactataatgttcaatttagagttctaagtataaaatatttttacttatttatttatttttgtgacagagtcttgcactgttgtccaggctggagtgcagtggtgtgatctcggctcactgcagcctccacttcctgggttcaagtgatcctcacgcctcaacctcctgagtagctgggattacaggtgtgagccatggtgcctggctaatttttttttctttttttccttttctgagacggagtctcccactgtcacccagggtggagtgcagtggcacgatcttggctcactgcaacctctgcctcccgggttcaagtgattctcgtgcctcagcctcctgagtagctggaattacaggtgtgagccatcaagcctggctaatttttgtaattttaatagatacagggtttctccatgttggtcaggctggtcttgaattcctggcttcaagcgatccacccaccttggcctcccaaagtcctgggattgcaggtgtgagccgctgcacccagcctgaaatatctttaacacaagtttgggtctgatccatggcatgttagtgtcatcactttttcattctctgagagaaagataagaaaaatggaattctaagattttgtaaaggatatgtgtttttaagggagaaggtactagaaataataaaagtcaagaaccaaaagttcttaggtcaattattttgacctaaatatatttcacaatagaggttcaagtgggttaactagactccctgttagaacaaaaatacctatgaagaaggttaagtttatatagtcatttatttgtataaatatttttctattcagagcaattcttagtggttcagatttttatgaaggagatcgatctgcagagaaatgtgaaagtgattttgtacaaatggtgggatatggcaagattcagtatcatttggaagtttggacactgacaggctctgagcattggacactgagggagagggaggtacacgaggcctggtaaaatagtttaacttttagttttgcattaggttcatccttttggaggttagtatgccgatgaaaaacaaattcacagagcagcttggtgctgtcagtaccatggacagaatgatgtgaatgagacacatctggatttagattctgttccatttgtgtcattcatatgctttgtgatttgggcaacttaattaagtcttgtttatgacacagatgataattaacgtattgatcttagcatcttttaagtgttcctttgttccttgagtcatcactttctcttctgtccaacttaaattttatagtattttgttatctatgatttgcattctcaacttccttgcatataccctcagctttcttgtctcactctcacttaagtccagcttaaatccagccatttttaaactttaagttagtatctgttagtgtctaaattagcagctatatacgtcgagaggaaaatgcagaatcatgctgactagttttacttaaattcatggtcacaaatatcaagtatcaagtgagtccttaatactacctggcattcatattgtattttcctagattgtttattcttctattttcttagatgacttatttaatgttttctctcatcagaccttccaacatctcatcctcaatctctcagctgatgattttggttcctacctcactgagaaaattgaagccatcagaacagaacttgcatagactccttttactctgtctacccatctaccaccatctccatccatataacctatctttctacccattattctttacttttctataaccaatcccttcgtttgtgcattagaatctatttcctaatggcttcttagggacattgctccagcagttctccactctcactcctatgtcataaagttttttcatactgcatcactaccacatgaagacaaacctactgctacctctgtctttaaaccttcttttgtttgacactacttcccttaccagataacagttatttgctttccaattgcagcaaactccttgaaaggattatctgtgctcaatgactctaatttctttcttcctgtttccttttaaatccagtataattaggcttctgccattatcacttttgttagtccattctcgcattgctataaagaaatgcctgcgactaggtaatttataaagaaaagaggtttaattggctcacgattctgcaggccatacaggaagcatagtgactgaggcctcaggaaacttacaatcagggcggaaggcaaaaggaaaaaaggcacattttacatggccagagctggaggaagagagagagagtggggggagatggtacacacttttaaacaaccagatctccttacaactctgtcagtatacagtaccaaggggggttggtgctaaaattaattcatgagaactatacccctgtgatccaatcaccccctaccaggccccacccccagcattggggattacatttcaacatgagatttggatggggacacagatccaaaccatatcatcactgaattgaaactactcttgataaggtcaccaatgatcttcatattgctaaatctcaagttaatttctcaatagtcatcatttctcttgacttagcaacatttgatttagttgatcattccttcttatacatacttttttttcacatgacttctgggatgttatactttaaaaaaatcttctgcactcactttcttgatgatcgtgactgtaaataccaagtatgtgcttacaactcctaaatttatgtacctgtttaagaaactattcctgaattgtacacatatatacacctatgtctgtatctacttgacattactatttgggtgtcttagtgacttaattaatatattccaaatactgattccctgcctaacacttgctcttcctagagtatttgtcagttagtaaatgtctactctttttctagttggggctatccttgagacttctcttgctttctcccacagccaacttatcatcaaaatgacgatcaaaccatgaaaacatatcccagatgtgtcaattccccaccactttcactgccattaccctggttcaaaccaccattatctctcacctggattactatagtaacctcctatcttgtctctcagttacccttttacacatccttttgcagtcttttccaaacagcctgagtgatcccttcaaaaagtaagtgaaatattttactactttgctgaggactctccagtggctcttcatttcactcagtttaaaagccactggcctaaaagggcgtataggatctgaccacctgttagttttttctgtgttacctttctacttttattcttttctttagtctttccacttctattcttttctttagtctctccacttcagccacactgacctcattgctgttcctggtacatgcagatgggctttcaccttaggatttgtgcactgatgattctctctgcctagaatactctttcctcaggagtcacatgaccaaattccctcaaatgtcaccttctcaaacgactgtaattaaaattacagcctcttctccttttcacatacacccttcccctatatactcctaatcctctttgcctgttctgtttctttcctatagcatttattgctgtttaaggtaattcttaatttatgtattgtgttaacatttgtctttctcctcgtttgaataagtttcacttgttagaagggcaggattttcatctattaggtttgtttaccgatatatttcaagtacctagaatagtgccttgcacattgtaagtgcccaatgaatatttgttgaatgaaagaagaatgcaagcctttctttttttctttttttttttttaatttatttattttttattgatcattcttgggtgtttctcacagagggggatttggcagggtcacaggacaatagtggagggaaggtcagcagataaacaagtgaacaaaggtctctggttttcctaggcggaggaccctgtggccttccgcagtgtttgtgtccctgggtacttgagattagggagtggtgatgactcttaaggagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatatttcttagtacagaacaaaatgaaaagtctcctgtgtctacctcctactacacaaacacggcaaccatccgatttctcactcttttccccactttctactccacaaaaccgccattgtcatcatggcccgttctcaatgagctgccgggcacacctcccagacggggtggtggccgggcagaggggctcctcacttcccagtaggggcggccgggcagaggcgccccccacctcccggacggagcggctggccgggcggggggctgacccccccacctccctcccggacggggcggctggccgggcagaggggctcctcacttcccagtaggggcggccgggcagaggcgccccccacctcccagacggggcggctggccgggcagggggctgacccccccacctccctcccggacggggcgactggccaggcggggggctgacccccccacctccctcccggatggggcggctggccgggcagaggggctcctcactttccagtaggggtggctgggcagaggcgcccctcacctcccggacggggcggctggccgggcggggagctgacccccccacctccctcccggacggggcggctggccgggcggggggctgacccccccacctccctcccggacggggcggctggccgggcggggggctgacccccccacctccctcccggacagggtggctggccgggcagaggggctcctcacttcccagtaggggcggccgggcagaggcgcccctcacctcccggacggggtggctggccgggcggggggctgacccccccacctccctcccggacggggcagctggccgggcagaggggctcctcacttcccagtaggggcggctgggcggaggctcccctctcctcccggacggggtggctggccaggcggggggctgacccccccacctccctcctggacggggcggctggcctagcggtgggtgacctccacctccttcctggacggggtggctgccgggcggtgacgctcctcacttctcagacggggcggcttcgggggggaggggctcctcacttctcagacggggcggccgggcagagacgctcctcacctcccagacggggttgcggccgggtagaggtgctcctcacatcccagacggggcggcggggcagaggcgctccccacatctcagacgatgggcggccaggcagagacgctcctcacttcctagatgggatggcggccgggaagaggcgctcctcacttcctagatgggatggtggctgggaagaggtgctcctcactttctagatgggatggcggccgggcagagacgctcctcactttccagactgggcagccaggcagaggggctcctcacgtcccagatgatgggcggccaggcagagaggctcctcacttcccagacggggtggcggccgggcagaggctgcaatctcggcactttgggaggccaaggcaggcggctgggaggtggaggttgtagtgagccgagatcacgccactgcactccagcctgggcaacatcgagcactgagtgaaccagactccatctgcaatcccggcacctcgggaggccgaggctggccggatcactcacggttaggagctggagaccagcccgtccaacacagcgaaaccccgtctccaccaaaaaaatacgaaaaccagtcaggcgtggcggcgcgtgcctgcaatcgcaggcactcagcaagctgaggcaggagaatcaggcagggaggttgcagtgagccgagatggcagcagtacagtccagcttcagctcggtatcagagggagaccgtggaaagagagggagagggagaccgtggggagagggagagggggagggggagggggagggagagggccgcgtgtaacctttgtaacttcacttcagcctctgaatgcaagcctttcaagattgaatagatattaaatgtgataatgtacttgtatgggcctcaaacaatgactgacattttgtacatgttcagtaaatttgctctttttctttctctatttcttaattacttgggatatctggaagtgtacagagtgctgtagatttctagatagcttgttttattccagtgttcttggtggagcctttgtggctgaatccagcttttccctcatgcttctttttgccttcttcctctatccaacagaggtggtgggaagaattagaattaaagcaggaggaagggaaaagaaatcttagctttttgtagatgggtgaaaaattggttagacttcagcttttaatgatctttcagtttagtaggtctcatatttttcaccatatgttattttctgattcacagtttctggtatatagttgatgcttaacaaatttttggatgattgttttccatttgttttgtggaatcgatctttccaaacatagcaggtcttttctattgattaaaataagtaaaagagtctgaaaactagaggtttagttcagaatgctgagcaaaatctggtattgtcatatgacgcatgggccaaggggagaaaatatagttacacagtgaatcagaaatagacaagttttggcaaggacaaggtatttgaaaaagtatagccctttaggttttataaagctttttctgttgttgttttattcttataaaactcttttgttatgccagtattataatgggaagctgaggctcggtgtggtgatatatcctgtacaaggtcaaacagtaagtatcagttcgtcttaacagacaaatttcgtgttcattctggtaagacaaggaaacaggacaacaacaacaataacgaaacaatgttctgaggcatttatgctgggttcatgtactggtgtgcataccatacatcatatcctttctctgatcctgataacctttcacagggtgatggttatgatacttaaaaatgagataataaatataaaagtgccataaaacattgtgttgttggtattattattccatcataggatagcaagtaataatacaggcatactttgttttagttcacctcatggatattgcatttttcacaaattgaaggtttgtggcaaccttttatccagcagacttgttggtatcattttttttttaacaacgtgtactcacttcgtgtttctgtgtcatgtttttgtaattctcctagtatttcagcctttttcattatcatatctgttatggtgatctgtgatcagtgatttttgatgttactattgtaattttttttttttttttttttgagatggagtctcgctctgtcgcccagtctggagtgcaatggcacgatctcggctcactgcaacctcttcctcccaggttcaagagattcttctgcctcagcctcccatgtagctgggattacgggcgcccactaccatgcctggctaatttttgtatttttagtagagatggggtttcaccatgttggccaggctggtttcgaactcctgacctcagatgatccacctgcctcagcctcccaaagtgctgggattacaggcgtgagccattgcacccagcctactattgtaattgttttggggagccatgaactgtgtccatataatatggtgaacataatatgtgaattctgactcttccaccgacgagcagtttccccatctctctcgctgtctcctcaggcttccctattccctgagatacaaaatattccctgagtattgaaattaggccagataataatcctacagtggcctctaggtgttcaagatctagagatcctgatttaatgtgagacacatccctcagattaaatcaaaagctagaaatggttaagcttagtgaggaaggaatactaaaaactgagacaggtggaaaggtaggcctcttgtgccaaatagccaagttgtgaatacaaaggaaaaattattttaaaaaatagcagagaacatttattctgagagatttgtatattatacttctgaggatctaagagaaaataacaaattttcatatttcagttaaatttatggaaatacaaatggtagcatctgtattcctaccatttctgactttttacgtgctctcattttattggtttcactttttatactatatctctaaggataatgtatctaaatatatgtattatgtgttaatttatatataaataaaagttatcatatacttccatggtatgattatagagaaaaatttttacattagaatgtgtctaaagtttttttcttaacttttattttagttttggggtacatgtacagattcattatattggtaagttgtgtgtcacagggggttggtgaacagattattttgtcacctggaaaaattattgaaggaaatataaagtgctactccagtgaatacacaaatgataagaaagcaaaacagccatatcgctgatatgaagaaagtttgagtagcctggatagaagatcaaacaagccacaacattttgttaagccaaagcttaatccagagcaaggttctaactcttctcaattctgtgaaggtcaagagtggtatggaaattgcaggagaaacattgggagctggctagaggttgattcgtgaggtataagaaaagaagccatttccattacatgaaaatgcaaagtgaagcagaaagtgttgatgtgatacttgcagcaaattatatagaaaatctagttaagatcattgattaaggtggctacgaaactacagattttcaatatagatgaagcagccttatatattgaaagaagatgccatctagtgtcttcatagctagacaggaaaaaaaagcttcaaaggacatgctgagtctctcattaggggttaatggagctagtgactttaagttgaagccagtgcttatttcctattctgaaatcctgtgccattaaaaatgatgctaagtcattctgcctgtgctgtataaagggaacaacaaagcctgaatgatggcacatttgtttacggcatggtttactaaatattttaagcctattattgatacctactgctcagaaagaaagctttatttcaaagtattactacttattgataatgtacctagtcacccaagagctcagatagagatatacaaggagattaatgttttcatgcctgctaacccaacatccattttgcagcccatggatcaaggagtaatttcagctttcaattcatattaagaaatacattttgaaaggctatatagctaccatagatagtaattcctttgatggatctgagcaaagtaagtgaaaaaccttccggaaggaattcagcattcttgataccattcagaacaatcatgattcatgcgaggaggtcaaaatgtcaacattaacagtaatttggaagaagttgaatccacccatcaagacttcactgatggatgtggtggaaatagcaagagaactagaattagagatggagcctgaagatgtgactgaattgctgcagtctcatgataaaactggaatggatgaagagttgcttcttatggataagtaaagaaagtggtttcttgagatggaatctactcctggtgataatgctatagacattgttgaagtgacaacaaagggttttaattattacatgaacttagttgataaagcagtagcagggtttgagaggattgacagcaattttgaaagaagttcttctgtcagtaaaattctatcaaacagcattgcctgctacagataaatattttgtaaaaagaagagtcaactgatgcagcaacttcattgtggttttattttaagaaattgccacagccaccccaaccttcagcagccaccaccctgatcagtcagcagctatatacattgaggcaagactctccaccagcaaaaagattatgattcactgatggcttggaggatggttagcatttttttagcagtaaggtttttttttgttgttgttgtttttttttgagacggagtctcactctgtcgcccaggctggagtgcagtggcacgatctcggctcactgcaagctccacctcctgggttcacgccattctcttgcctcagcctcccgagtagctgggactacaggtgcccgccaccacgcctggctaattttttgtattttttagtagggatggagtttcaccgtgttagccaggatggtctcgatctcctgaccttgtgatccacccatctcggcctcccaaagtgctgggattacaggcgtgagccaccacgcccggccagcagtaaggtatttttaaattaaggtatgtgcattgtgtttttagatataatgcttttgcactcttaatagaatacagtattgtataaacaaacatttatatgcactggaaaagcagccagttggtctttaaaattcctttaccctgtctttcagtaacactactctttccttgtttatcactgatctttgtagccactcattctctacagaatttttcttcctctgtgtggtcttaaatatctgtgttttttgtagttcatccctggtccttagcccattttactctagatgtcattttgaggtaacctttcctatacttgatactgcctcctatatctaagtcttgagctagaaagtttgttgctcttcggatattcacattgtgttctccattcactttttgacttggttatcctctagacacctgtattagtccattcttgcacggctataaagaagttcttgggactgggtaattgataaagaaaagaggtttaattggctcagtgctccacaggctgtacaggaagcatagctggtgaggcttcaggaaaatttcagtcatggcggaagatgaaggggaagcaggcatgtcttacatggccagagcaggaggaagagaaagaaggaggaggtgctacacagttttaaacaaccagatctcgtgagaactcactaagtatcactagaacagcaagggggaatccatctccatgattcaatcacctcccaccaggccactcttccaacattggggattacaattctgcatgaaatttgggcagggatacaaatcaaaaccgtatcagcaccccttcatgccccaaagagaaaccaacctttatctttgaaaccttgtcactgaagctcccagcctggttaagagggacttctgattctataatctaaaaatcatgaagtcatcttagacacctccctttcatttttccccacatctacttactcattaatgtctggctccctagtatgcctggaaatctgtttactttcctggtttttattctgtataatcactatcatgagcaaaataagaacagtcccatctcatcagaaagttatttcatacctgacactttctacttcactgttcccatctcattttctaactcatcctgcttccagcttctaatttccaatgtaagaccttacaactaaataactgcatttactcactcccctagtgtgatttttaaatcacattttaaacttttatatacgttataagccctactttacagtgttttattttgctttaaacagttatttgatttttaagtgaattatgagaaaggaaacagtttttgtgtttaccaatttatttaccatttctgaagctcttttttcctttctgtaagtctacatatccatttgatagaatttgtctttggtctgaagaacactcttcagcatttcttacaatgtagattgactggcaagcattctctcagcttttgtttagctaaaaatgtctttattccaccctcatttctgaaggatatttattattgatgaatataaaattctaggtcgatagccttcaccccccaagtactttaaagatatcattttactgttttctgacttccagtgagaggctgggaataattcttatttctcccatacatgatgtctccctgcctccctttctttttgtcccttttctggctgctttcaagattttttcttacttttgtttttaatcaattgattaaaactgtattgattctaatgtatctcagtgtggttctctttatatttatcctgtttgggattggctaaacttctttttttttttcttttttcttttcttttcttttttctttttttagacaagagtttcgttgttgtttcccaggctggagtgcagtggcacgatcttggctcactgtaacctccgcctcccaggttcaagcgattccctgcctcagcctctcaagtagctgggattacaggtgcccgctaccatgcccggctaattttttctatttttattagagaaggggttttaccacattggccaggctggtctcgaacttttgacctcaggcaatctgcccgcctcggcctctcaaagtgctaggattataggcatgagctaccgcacctggccctaaacttcttaaaagttggtgtttttcatcatatttgagaactttctagtcactatttttaaaatattctgccccagtctcactcttttctcctctaggatcacagttacatatatttcaaacaatatgaaattgtcccaatggcctctgaagcttcatttatttctcttcagccttttatctctctgtcaggttagagaattttgattgattggtcttcaacttcacttttcctgccaacgtcaatatactgttaatcctctccaataatattttaattttaattattgtactttttttttttgagccagagtctcactctgtcaccaggctggagtgcagtggtgcgatctctgttcactgcaacttctgcctcccgggttcaagcaattctcctgcgtcagcctcctgagtagctgggactacaggcatgggccaccacgcccgcctaatttttgtagttttagtagagacggggtttcaccttgttggccaggatggtctccatctcttgacctcatgatcctcctgcctcggcttcccaaagtgctgggattacaggcatgagccaccacccccagcctcagttattgtactcttaagctctggaattttcatttagttcctctttatggtttccattttgttaatttctcagttaatctaaattattgatttttaacgtgatagtttctttgactctatcttctctttgtttaatttcatcaaaaatcctcttatttcatcttattatgaaatgattctagatacaatttaatataaattaacaatatttggctgcttatctgaaagtttatattttggaattttttttacttttctgaaccttctgtgggtttttatgcttgaaaatagcatggacttatttgtgccaggatgcatatgtgatcaagggcagagatagggatagaaataaaattaaggttaggttctatagaacaacagccagtgagacaagtaggactgtggcttcaataaagtcttaaattgagtataagtggcagtggattacattttgctcttatatttttgtattcgtccattctcacactgctataaaggatactacctgagactcggtaatttataaaggaaagagatttaattgactcacagttgcacatggctagggaggcctcaggaaacttataatcgtggcggaaggcaaaggggtagcaaggaccttcttcacatggtggcaggagagagtggaatgagagcacaggaaaaactatcatttataaaaccatcagatctcataagaattcattcgctatcacaagtacagcatggaggaaccaccctcataatccaatcacttcccaacagtttcctcccttaatacccggggattacaattcaagatgagacttggatacaaagctaaaccatatcagctgtcaattatatagtcagggaatcatagacttttagtacttgtacaaactttagaaatgatcctctaacaagctcattttcatactgataaaatgtgtgtgctaggatttcatacatgctgggttgaatgggtaggtgataggtacctccaatgtggactgttaggccaagaatgttacattatgaagggcattttaaattaggatgtgaagcaaatgcttgaagtagaagccttcatatattctagtacccaaagatactatgacagttgccatgaaggaaccttataaagctctcagccaatatatggcagataatattaatgtatagcttcagaatattggaactaaagtagattcataatttgcaggataaacaggtcaccagtttaaaaacagaaaaaaatccccacaaaaaaaacaaaagaagcgtaagtacttaacgtttattgtgtcacagaaatctgtagcagattctgaacatatggtaggttacatagatggtatattatgcatatggtatatatataacatacatatttacttatggacacatatttgcctaaattgcattaagttctataatattactgagtaataattttcctccttttctgtattgatacagcatctgtaaatgcttatcaataggcaaatgaagtgaatattttgcagatgtctacagtttatcactgtctccctcacatctatcacaatgtgtggcgtatggtaggtgcttaataaatatttgttgaatgagttaatgaatgtgtcctatgattgcccccccgcaacccacgctgccttttgaaagactcattgctttgaaagaatatgtagaaagatggatttcatttttatactgatggtactaccaaatacattatcattgtaaagttcagcgataagacaaaaaaagaaaaaaaatcctgtgaaatagaactgttatcccctaacctttaggtttgtcttagtgtttgggatttctcctgagtcatcttaggagaacactaacttatctgttagtgaacaagtaataactaaagcatttttatgtgatgggtaactaaagttttgagactttaaaaaaacccctactttaatggttttcatttattttggtaatcattttctaccttatattgtttattatttatgtgtttcatgtgcagtctttgcttagcaatggggatgtattctgagaaatacataatttggcgatttcatcattgtttgaacatcatagaatgtacttacacaaacctagatagtatagcctactacacacctaggctatatgttatagcctattgctcttagactacaaacctgtataaatgttactgtactgagtgctgtaggcagttgcaacacagtggtatttgtgtatctgaagattctaaatatagataagatacagtaaaaatatgatgttataatcttatgagaccaccatcatatatgtggtccatcattgaccaatatgtcattatgtggtacatgactgtatatgaatattattcaactagattgcatacttcttaagtataaagaccctcttttacacaattttttgccatatagcatagtattattcatgtagttgatggtcagtacatcataagatttaaaaggtggttgcagaacacaactattatccttgaaactctgttgatctttaagctttgactctaaagagatgtcgttaatggtttttccatccagttctctttctaagggaaacaacttctgtactcttggttcctgccaaagaggtatgcccaaaaaactaagggtatggaaatagaaacaactaggaatatccaaataatcctgctagatatttagttttaggtacacattctgatctataaaatgaaatgaaactatttatattcacatcagtgaattttgagaaatgagtgtaagtgatagagccaaaacttttggtcccataattatttatgcctgcatttaagaactagttttaaaaatatgtttatataattttatattaaatatatatcattgaattaattgaggatttacagaagtactttatattgacttatttcattataattttaaattggtgtttcttcatggcaactgttatagtatctttgggtcctagaatacacaaaggcttctacttcaagcatttgctacacatactaattaaaaaacaaaaacaaaaacaacctgataggctgagtgcagttgctcatgcctctaattcctgaactttgggagccaagacaggaggattgctgagcccaggagtttgagacctgcttggccaagatgacaagaccgtttctatacaaaaataaaactaaaaaataaaattagctgggcgtggtgacgtgtgcatgtagtcccagttactcaggaggctgaggctggaggatttctggagcccaggagtttgaggtggtagtaagctaagatatggccactgtactccagcctgggcaacaaagcatgaccctgtctgaaatagatagatagatagatacataggtaggtagatagatagatagatagatagatagatagatagatagatagatagaatgaatttaatgagcgctaagatataaaagagtattttcccaaattttgttgagaatataataataaaatgatggtttaatggaggggaacttataatttaagtgaaagaccagtcattatgaatttaagtgaacattcagtgagatactttgtacttacaagtagaatgcttatttgaattatctttagaaatcatatctttaagaatttgtcttcagttatattggcagaattctgatgattttaagaaatattcccttttaagggaaaataagttacttttttgcattaaatcataagttagaacatactacataattattaaaggtatatataactttttttctcagagccttcatgttttctcatgaataagaccaaagtgttaagttacaagaaaggtagttgagggctgtcacattatctgtatgttcccctctggattctgcttaaatgtggttaaacaaggctgccatcagaaatcaccttgacttttaaaagtgtgtctgatttcagaattatgcatggaatgaatttcttaaaagttatttattacttattatatgagttattaatacaatctagtagttgtagaattctaaattatgataaccttcttgcccttgattctcatttttgtttgagaatgtttctttgccctggctgcaatttataatatggtgctaattactattcacttgagacaacatttgatgtttttaagtatataattattattttaggagtagtttagtagctcctttgaaaagttacaaaaaccttctcaatgaaaatattttctctttaaaaacctgagaaaatgatttttttcctaaaacaaaactcctaaatcaaagtgggatgggtctccagttgaagagttggtagtctttaccacagtaggctagtaagcgtcagtgtataagatactgtataagcttatagcttcctgaggaactatagcatcatgatagtatatactcccagtcagaatttattttcaggaatgacataaataccttgttataactgatattttgtacaaagaatactgaaatacagtgaggaaaatacatagagaagacaacactgattactgaagatcaaaaatttttttatatgaaattctgtaatctgaacaaatgaagaggcaaggtgtcagaaagtgaaaaataatctgattttactatctgtatcttatataatgatattcatcaaacccctgtatatttttttatgtcataggcctccattcaataagtctttaatgtgctcttagtcttgatatgtaatcctactgttaaaggctttattacatgttttaagtcattcttactttactttttaattgcttatgtcatttaatatagagttcattctgtaaatgtaattaggtaatgctattcttactaagttaatcttgaattaacagcttttcttttttattattttattttattattattatactttaagttttagggtacctgtgcacaatgtgcaggttagttacatatgtatacatgtgccatgctggtgtgctgcacccattaacctgtcatttagcattaggtgtatctcctaatgctatccctcccccctcccccaaccccacaacagtccccagagtgtgttgttccccttcctgtgtccatgtgttctcattgttcaattcccacctatgagtgagaatatgtggtgtttggttttttgtccttgcgatagtttactgagaatgatgatttccaatttcatccatgtccctacaaaggacatgaactcatcattttttatggctgcatagtattccatggtgtatatattgccacattttcttaattcagtctatcattgttggacatttggcttggttccaagtctttgctattgtgaatagtaccgcaataaacatatgtgtgcatgtgtctttatagcagcatgatttatagtcctttgggtatatacccagtaatgggatggctgggtcaaatggtatttctatttctagatccctgaggaatcaccacactgacttccacaatggtggaactagtttacagtcccaccaacagtgtaaaagtgttcgtatttctccacatcctctccagcacctgttgtttcctgactttttaatgattgccattctaactggtgtgagatggtatctcattgtggttttgatttgcatttctctgatggtcagtgatgatgagcattttttcatgtgttttttggctgcataaatgtcttcttttgagaagtgtctgttcatgtcctacacccagtttttgatgtggttgtttgtttttttcttgtaaatttgtttgagttcattgaagattctggatattagccccttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgtctgtgtcctgaatggtaatgcctaggtttttttctagggtttttacagttttaggtctaacatgtaagtctttaatccatcttgaattaatttttgtataaggtgtaaggaagggatccagtttcagctttctccatatggctagctagttttcccagcagcatttattaaatagggaatcctttccccattgcttgtttttgtcaggtttgtcaaagatcagatagttgtagatatgcggcgttatttctgagggctccgttctgttccattggtctatatctctgttttggtaccagtaccatgctgttttggttactgtagccttgtagtatagtttgaagtcaggtagcgtgatgcctccagctttgttcttttggcttaggattgacttggcaatgcgggctcttttttggttccatatgaactttaaagtagttttttccaattctgtgaagaaagtcattggtagcttaatggggatggcattgaatctgtaaattaccttgggcagtttggccattttcacgatattgattcttcctacccatgagcatggaatgttcttccatttgtttgtatcctcttttatttcattgagcagtggtttgtagttctccttgaagaggtccttcacgtcccttgtaagttggattcctaggtattttattctctttgaagccattgtgattgggagttcactcatgatttggctctctgtttgtctgttattggtgtataagaatgcttgtgattttttgcacattgattttgtgtcctgagactttgctgaagttgcttatcagcttaaggagattttgggctgagacaaaggggttttctagatatgcgatcatgtcatctgcaaacagggacaatttgacttcctcttttcctaattgaataccctttatttccttctcctgcctgattgttctggccagaacttccaacactatgttgaataggagtggtgagagagggcatccctatcttgtgccagttttcaaagggaatgcttccagtttttgcccattcggtatgatatcagctgtgggtttgtcatagatagctcttattattttgaaatacatcccatcattacctaatttattgagagtttttagtatgaaaggttgttgaattttgtcaaaggccttttctgcatctattgagataatcatgtggtttttgtctctggttctgtttatatgctggattacatttattgatttgcatatgttgaaccagccttgcatcccagggatgaagcccacttgatcatgatggataagctttttgatgtgctgctggattcggtttgccagtattttattgaggatttttgcatcaatgttcatcaaggatattggtctaaaatctcttttttggttgtgtctctgcccggctttggtatcaggatgatgctggcctcataaaatgaggtagggaggattccctctttttctattgattggaatagtttcagaaggaatggtaccagttcctccttgtacctctggtagaattcggctgaatccatctggtcctggactctttttggttgataagctattgattattgccacaatttcagagcctgttattggtctattctgtattctgtcgaatcctgaggtttcttgaatctgaggtagcatggactaaaattgccattttatttcctaacagttgcctcacagatttcattttacatataaggaaattggtgcccagatgttgaagaaatagggtacccaggtttacacaaatatttagctattggactgtaactagaatatagtttatcttatatctagttttaatctatatatgtgtattatttctagaattaggctgagtaaattgacattaatttaaaaaacaaaagttactatacttttagttttctattgttatacaaaattaccataaatgttgtgccttaagcaataaaaatttgttattatgtagttctgaagatcagaggtccaatacaggtctcagggctaaaatcaaggtgtcaatagggctgcatttctttctgggggctcgcagggagaatccagttccttgccatttccaccttctagaggctgcctgcataccttagctcatggcctcttttcttccttcttcaaagccaacaatgatgggttgagtccttctcacactgccatttgccctattctctttctttgaaaacaattgggaaagggtctctcttttaaggactcgtgatgagattgggccaacacagataatccaagataatctccacatctcaaaatccttagtattaattgtatttgctacatgaagggaagaaaaaatgtccttttttcctccctctactctcctaagttctgtctctggggtcctgtaaattagactgataagagacagattaagtttcagttagatgaataaattctgcggatctatttcagtgtgatgactctagtattgtatacttgaaaattattcagacagtaggtcttaaatgtacttaccacagaaaataagtttgtgaggtgatggatacattaattagcttgatttaatcatttttacaatatatacatatatcaaaacatcacattgtgcattataagtatatccaatttttatttgtcaattgtaccttaacaaaatttggggtgggggaaacagataagagaaaatgaaacaaatttattaacatgtggattgcttatacacaggagagtactcaatgattagtaactcaaagcgtttgttggaatttgggcttacgtatccttttaaccaaagaataattttgtagagggaagacaggacgaaggaaagggactttgagctactaagaacagcaaattgtaggataataaatatacgcgggaaatcaatggaagataagggatagtatggtttgctcagtagattcttctagtgctgtcttttggctgataaggttctggaattgtctttggtgataaagtatcaactaagaatcgaatagtcctgccctttctagtagagaggaggagggcagaggattttgtgtctgtgtgtgtgtgtgtttgtgtgtgtgtgtgcgcaaacttgccttttcttaattgacgttagctcaaaataatccttatgcgaaagtggcgtattttggggtggcatactctgaattccttgatgtgtaagatatattcacaggttctagagattaggacatcgacagctttcgtggggagatattctgcctacaaactatgcatttaaaattcattttctcctttaagggattttattggtataaatatataatctatgaagaacttatgaaataagttttaatgctctagacctctcaaataataacttttaattattagactaataaacgtagtttcttgaatgctagaaatatgattttcaaaaataatatggggtgtaacatctaatgtgactaacttttcacaatgtattaagatgtaatttaagcttcgtatcacatgtgtaggggttgctacatggtgggtttactatatatgtacctgattcttttttgataggtctactggtccaaaggcaagaatgaagagttctttctgtattatttttgaatactagatttcatcttaatgacttcactccttttccttttagctctctaaatttttcttgtggggctggttttatgctcatttgagcattcacatgttcattcagccagagcttaatttaggaccaatcctttctctaaaggaaatgtaagcaatcctaagctagtaactaagctggttgttatagtctcattttacattccaattctaatgtctttctttatttcttatgaccaaacctttttctagtagttcattttcagtatcccgtctgatttactaccatatctttgtgtagaaaaaactgctgctaaaacttaggcctcatggctggttttttatttttattttttttcttggccaacttaatcttgctaattctgattgcttgcatttccattcactggatgcttatcattctcttaagtgatggtaatttctagtctggcttttcttgcttactgacaaaaccttggttctgatattcagagtttaattcatagaccatagcaagtttttgtcttagtgttttgcattactattatggtaagtacacagtaagcgtttgatgaatacttgcatgtttcatttgaaacattcagagggcatgaacgtatatgactctctaatgatttctgaagttcccattcatcttcatacatctggggaattgatagctatctctatgtaaatgtgattccttattaaattatagggagattgggtttaaaaaaataactgtccttatctaccctggtggttcttagatttttggattttatggactagtaaaatgtatttaaaaatttggaggatgtacaaagaagtgtaactttttatatttctaaataagagcataataaaattaaactataatcagctctcaccatgatatcataaaggaacatttgaatatcaaaaaacttggaaagacaaagtcactgaataaaaaaattttataaattcaataaatttagctttatacaaaaactcaatatattatcttttacttttccatgtttacttagaatgactaaaacttgctttaaaaaatgggtcttgggtaatgctaatatagtcatcccttttatttaagtagggcctgagactttcctaaatcctaaaactagccaatgattgaaagcaaggagtaggaggtatttaaagtatagtcttttgcttaggatggtttcctttgaacacaaatccaacattttgatatatgtagcaaataacaatttatcatttctgcatcctttcttttccatttcttacaaaaatatcagtggttccaggtcactgtgaggtaggtatagtaagattttgtgtgtgtgcgtgtgcatgcatatgttcacgtgtttggtggtatgcataaaagtggttgtgtgtgcatgcatatttcagtgtgtcatacacaccctactatcaaataatattatcattaagcctcaattttaggtagccactatgaacctggatcttgggaatatggcctttactagtgttcttgtccttcttcctgttgtgatgctgggactagcatgtatttatgttcctccccaagaagtggagttacctctttgcccatgtttttctctcttagcttcagtgagtttccaccaagctatgatactgatgcacttcctcctaaaaataaaggattttgttgcttagaggacatgggccagatgggtcttggcagcatttctcacctagtttcaatgagatttcaccagtgccctcagatacaggtttgcaggttaaggattttgttttgtaggagagataggatagatggttctgagtggctttcaacactgactactattctcttttagccagcagtgagtagcttactcagaattgtcccctatctgtgtgtgtgtgtgtgtgttttgaggtggggtctcactctgttgcccaggccgcagcagtgtatggctggatcacagtttatggcagctttgacctcccaggctcaagtgattctctcatctcagcctcccgagtagccaggactacagacatgcaccaccacacccagctaattttataattttttggaagagacagggtctcgctttgttgcccaagctggtcttgaactcttgggctcaagtgatcctcctgccttggccccttaaagtactggaattataggtgtgagccaccgtgcctggcctttatatataatttgattacaaatttactgaccacatgtggttgttaggactaaaataatcaatgtaaaaggattatataaagtgataatgattattactgtcctaatcacagttattatggttccaatatttaaaaatcaagaaagcagtagcaaaggatattatgtaatatatgtgtgaactaacagatattaacttactttttgcaattttatctttgtcatttcaccacacttaacatgaataatctgatatttaaaataggtaagtatgtactggagacagagtttcagatttgaaaaattattttaagactttcaggaaaaagaaacaatataagagcaaaaccaaaagtaaaaagaaaattcttttttttttttgctttctatctattcattttaagatcttctgtttctttcttatactatcagtttatcaatcctaaatattcttcttaccttcatcaagagtgatgataattttagcacttactgaactcatcatttcatgtcatttttcaaaaagtctacttccatctccctactattaccttttatattactaggaatttagttaattcatcttattgccttggagaaccttaaacttaaagcatctttgatgtttgagtatctatagcctacttaaaaaaaacctaaaggaagaaatgccaccattttgctgtactctattcaggtgtttaacagccctaattgaatagatgtttcctttaatcaaataggcttactagaaacataaattctaggctctgagattttttgttttttttaattttgcagctgacatgagaggacagctgtgctgttttatgaaggaataaaataccgaggaattgtattgacagggtctgtaacacaaaggcagttggtaaatactttcttattgtctacattttttgtagtctgagttgtatgctttccctacaccatgttgacttactgtaagtgttttaaccccactagacttgaggctccttgagggacagaattttatcttcttcatctgttctttaattatacctagcactgggaggtaattacttaatttttgtttgttggtttgttttctgaactggaggaattgttttgcattttagtggcttaagagtgtttatttacacctaaatattttgcagaatagagcagagaacatcacagtttggggcaaatcactaggtttctcttggcaacacaaggctgttgacatttattaaggagcttgggacttatcagagagttagcttctttagagttctttggaactttggagtatagatttggctgtagatgctgactggaaattaaggtgaaaatgtaatacagtaaccaaaagacgtggcaggttaggttgtctttaaaacagtgtggttggcactatgttttaaaatggagctagcactgctcaggtaggcagggcgtatcaggaaattcatcaagagaaggaattaccatcttgcagcagaattctgtcatttaacatatttttggggcatggatggcatccagtccccagataaaggatgaataagaaaacagaagcaggtaccggagccaaatccatccctagaattttgagcatatagagttggagaaagtggagactccagagcaacagtagagcctagaggcattatcagtcttaggtctttttagcagcgtaggggactttggatggtggcgtagttttggcagcagtggctctaatgctaggccctacaagtagataaggctatttaatactgaattactttcatctgaagtcttccaggggcctgatcattctgtccagatgtggaacaagaaaatgatagatctaggattgttatgattctctttaaaattccctagggatttgtttggatctgggattgtaaagccatagagtacattgtgggttctcagtaaatcctttgagtgaatgaataaatgaaagcagccacttggatctcttatggccagtaatgcaacctggtttatttgtgaattatttccttagggaatgataatctcataacttcagcactcagatataaagtctacaggttaaattaccagtctgggttataggttttattggtattacttttgttgcttttgtttactgatatatgctccactcagtaactaattgtttaatacattttgttgtagaatattatgtttagtgtttaactttattttgtacctttgttaactaggtgtttttttgagtatattgtgggtatacttatgtaccaagtgctgcaagatctataaaaaaatataagatgtattccctgccattaacgagctcaagttagtgtagctaactcaaagaaaggtaggtaactatgccagtcagtaaatgaagagtacgatgagtgatagttaagaagaaaatgtttataagtgcacattcaaaactggatgatgtcagcctagtattttgaaaacattctcaaatattcaatttttaatgcactgttaaaaaataggaagtacttttatttcacattttaattagatgagaataactaatttatttttcattagtggtgttattagagcattaattttccaaaagaaaatttgtagaatgttaatgaagctacagtaggaaataaataaatgttctgtaaataatcattcaccatatttgatatttgattggtttagaacattaatacaaatgttcagaatattgttttgtgtttttggtaaaagcacattagtgttcttggttaggcctgcgtgccttgtttcctgttatggcattttaggccagattattagatctattttgatttaatggtaacagtgccatctactgagtcatcaacatgatataccgtctatatttccagaggaaaaaagaggagaaaatatatggttattcacttatttttgttttttattttatttttaaatttgattgctgctttattcagtctcagaagaaattttaatgaaaaagtatgagtaagcaggtgccttgattctaaaaatttccttggttggaaatagcaattgaactttaaatacattctctttctagtacattaaacagattgaattctatcaaaagcctacttgaactacttatagtatatctcactttatgcatcataatcccatgttttcctactttttatattctctattcctcaaacatatcttttctgcttcctagggcaaagcatttcaaatagattaaataataaataatatattgaatttttatattttcaactcagtgggataattaattatgaaaattattttgacagtccatcatttcttaagttcataagcatgtttataaatgtatgattagattttcccctgaaaagatgttttatagaaaagatatatttccaacaatgaggaatcttgagtaaaatgtattgtgttgtatactgtaactaaatataaatcatattcagcacatgaaatagtatatatttttatatttgtggttcttaattcattactactgagagattacctgtttaaatacttctgtttatagttacagaccttcactgatgaaagaactattctcccttaagaagttaccaaatctgtttttcatgcaaccttaaatcttttagtgttctagggactggattatatacaactgaaagggaaaactgtcactatcattgtgaagctgaattaaaatatagttaatattattttttgtagctcagcaactttttccatttgttaacagatacccttcctctttaacacacacaccattgtgctttctaaaaaaattaggccgaggcggtggctcatgcctgtaatcccagaactttgggaggcggaggcaggcagatcacttgaggtcaggagttcgagaccagcctggccaacatggtgaaaccccatctctactaaaaatataaaaatcagctgagcatggtggggggcccctgtaatcccagctactcaggaggctgaggcaagagaatcgcttgaacctgggaggcggaggttgcagtgagccaagatcatgccattgcacaccagcctaggtgacagagcaagactatctcaaaaaaaaaaaaattaaatttttgtttgacaaaattgtgtatatttatggtatacaacatgttttgttacatatatatatatagtggaatgtctaaatggagctaattaatgtatgcattacctcacatatttatttgttgtgaaaacagttaaatctgttagcaatttgaagtgtacaatatattgttattaactatagtcaccatgatatataatagatctcttgggcttattcttccttttagcagaaattttgtatctgatgaccaacacctcctcaatctcatcctccatccctagcccctgagaaccactattctattctctgcttctctgagtttcacttttttagatttcccatgagtgaaataatattctatttgtttttttgtgcttgttttatttcatttaacaacatggatgaatcttgaggatattatgttgtgaaggacaagatatatatattttttttaaggttgaatagtcttccaatgtatatgtatataccacattttctttatccattcacccattgatggacaattaggttgattccatatcttggctattgtgaataatgctgaaataaaacatgggagtgcagatatctatttgacatactgatttcatgtactttttttttttttttttttttgagatggagtttcgcttcgctctttttgcccaggcttgagtgcagtggtgcaatctctgctcactgcaatctctgcctcccgggttcaagcagttctgctgcttcagcctcccaggtagctgggattaccggtgcctaccaccacgcccagctaattttttgtatttttgggagggacagggtttcactatgttggccaggctggtcttgaactcctgatctcaggcgatccacctgcctcggcctcccaaagtgccgagattacaggcatgatcaccatgcctggcccaatttcatatacttttgatatatacccagaagtgggattattgactcaaagaattgttctatttttaattttttgaggaacccccttactgttttccattgtggctgtactaattcacattcccaccaacagtgtgaaaggatttcattttcttctcatcctcatttacacttattttccatctttttgataatagccattctaacaggtgtgaggtgatatcttattgtggttataatttgtatttccctgatgattagtgatgtggagcattttttcatatacctgttggccatttttatgtccttttttgagaaatgtctttttcaggtctttagcctgttttttaacctggttattttcttgctctttagtagtttgagttccttatatattctggatattaagctcatatcaaacgtatggggtgtattagtccgttttcacactgctataaagaaatacccaagactaggtaatttataaaggaaagaggtttaattgtctcacagttccacatggctagggaggcctcaggaaacttaacaatcatggcagaaggtaaaggggaagcaaagaccttcttcacgtggcaggagagcgaagagagggtgaagtgggaagagccccttagaaaaccatcaggccttatgagaactcactcactatcatgagaacagcatggggaaaactgccctcgtgatccagtcacctcctatcagatccctccattgacacatggggaattacaattcgaaatgagatttgggtggggacacagagccaaaccattatcatatggtttgcaataattttctctcattctgtaggctgtctcttcactctgttgatcatgtaccttgctgggcaaaagacttttagtttgctagaatcccatttgtctatttttgcttttgtttcctgtgcttttggggtcatattcaaaataccattccctactttgggaggctgagtcaggcgaatcacttgaggtcaggagtttgagaccagcctggccaacatggtgaaaccgcgtctctactaaaaatataaaaattagccaggcgtggtggcaggcacctctaatttcagctacttgggaggctgaggcaggagaatcgcttgaacctgggagtcggagcttacagtgagccgagatcgtgccactgcattctagtctgggcaacagagcaagactccgtctcaaaaatgaaaacaaaaaacaaacaaaataccattccctggaccaatgccaggaagcttttcccctaggatttctgccagtggtttcacagtttcaggttgtatatttgagtccttaagccattttgagttgatttgtatatgacgtgagataaaagtccagatttattctactgcatgtggattttcagttttcccaatatcatttgttgaagggactgttctttctccattgtgcattcttgacatctttgtcaaaaatcggttgacttatttctggtctctcttctattctatttgtctatgtgcctgtttttgtgccagtaccatgctgttttgattactgtaggcttgttggagattttcaaatcaggcaatatgatgcatctagctttgtgctttttgctcaagattgttttcctatttaaggtctttggtcgttccatgtgaattttaggatttttctaaatctgtgaaaaatgccattggaattttgacagtggttacgttgaatctgtagatcactttggatagtatggacattttaccagaatttttacaattcatgattactgggtatctctcaatttttctgtgtcttaaatttttttgtgtgcgtgtttcgtacttttcagtgtgcagatttttcaattccttggttaaatttattcctctgtgtgtgtgtgtgtgtgtgtgtgtatacgtctgtttttgtagctatggtaaatggtattgttttttgatttttttcagatattttgttgttagtgtatagaaatgctactgatatttgtacgtggttttggatcttaaaactttactgaatctttggttagttttaacttttttttttgtagagtttagggttttctatacataagatgctgtcagcaaccaaagacaatataacttcttcctttccaattttgatgttttcatttccttttttgcctaatttctctaacaaagacttccattaactacgttgaatagaagtcgtgagagtgggtatgcttgtctagttcctgatcagagaagaaaagctttcaactttctactgttgtgtatgatgttagctgcacacttttcatatatggtctttattgtgttgtggtgcatccttttataacgcattgttttattttccctttgccttcttctttgacacactggttattgaataacctgttgcttaatttccacatagttgtggtttcctaccacatttcatatcattgtggttggaaataataaatgataccatttggatcttcttaaatgtattgaaacttattttgtgggctaacatattacctattatggaatgtttggtgtgcacttgaaaagaatgtggattctgctgcttttggaaggaatattctgtgtatatctgtgaggtccaatttggtccatagtgctgtttgattctgttgtttcattattgattttctcactggatgttctctttattgctgaagctgggatatagatattttctactgttattgttttgctgtctatttctccatcagtcctggtagtatttgtttacatatttaggtggtctgatgttgggtgcatataaacttacaattgttatattttcttgatgaactgaccactttctaattatataataaccttttttttttttttttttctgagacggagtctcgctctgttgcccaggctggagcacagtggtgcgatcttggctcattgcaacctctgcctcttgggttcaagtgattctcctgcctcagccttctgagtagctgggactacaggcaggcgcctgccaccacgcacggctaatttttgtatttttggtagagacggggtttcaccatgttggccaggatggtctcgatatcttgaccttgtgatccacctgcattaccctcccaaagtgctgggattacaggcgtgagccaccatgcccagcctatataatgacttttttttttaatctcttgtgacttaaagtctactttattatgaatacagctactcctgccctcttttggtttccatttccctggggtaccttttgctatcctttcacattcaaccaatttgtgtccttatagacgaaatgaatctcttgtaggcagcatgtagttgagtcttgtttttaattttttttttaaatatccattcagccgctctgtcttttgattcaggaatcagtccatttacaatcaaggtatgtattgataggtaaagatatgctactactaactttgcattttctggtagtttgtagattctttgtttcttatattctggctggctttctttttgatttatttttctgtagtagtatgctttggctcctttctctttattctcttgtatctactacagggtttttctttgtggttactgtgaagcctgtataaaacatcttgtcactctaacagattatttttagctgataattgatttaactttaaccatttactaaaactatatgctaacttctcctttcccccacattttctgttattcatgtcacaatttacatcttttatatattgtgtatccattaacagattattgtatctatggttattttactgcttttcttataactttcatactgtagttaaaagtgatttatgtaccgccattatagtattagagtgttctctatttgagtatattcttagcttacagtgagttttatattttcatatgtttacatgttgctagttagcatcctttactttcaactagatttctctttagcatttcttgtaaggtaggtgtggtggataattttaggtgtcttattgactgcataaggaacatatagggaattggtaaagcattgttttggggcatatccatgaggatgttctagagaagatttgtttgtgtgtctgagtggactaagtgggcaaggtctgctgtcagtgtgggtaggcatcatcctatcgaccatgggctggtagagaacaaaaataagggaaagacaaattggtctctgtctctgtcccagatctgggatatactctcctgttcttgaacattagtactccaggctctctggcctttgtacttcaagagttacacccctcccctgtcctatgttttcaggctgttggacttaggagtcagccatgttaccagcatagagtctgtagcttgcagatgacctgttgtaggatttttcagcctccataattacatgagccaattgccttaataaatctcctctcatatgtctatatttatatctatctatatatacatcctattgattctgtctctgtagagaaccttgactaatacagtgagtctggtaattacgaactctcaaagcttctgtttgtctgagaagatctttatctctcctttattcctgaaggacagcttgctgagtatagtgttcttggttgacagattttttttccctctcactttcagcatttttcagtattctcacatgctctcctagcctgcgaggtttctgctgagaaatccactgatcatcttataatgtttccccttgtatgtggtaggcattttttctcttgcagcataaaaacatttatttttgtctttgccatttgagaatttaattttaatgtatcccaattattttgaattgtcagatggtttgtaaatataaatttctttagagtcatttagtagtacattattttgccagtttttacagactggctttgacagaagaagctctttaccagtcagcctgtccagtgtttctgagtgggcttgctactagaattcttgggaaggctggcttagtgcccatgtcagcagtttgtcaggcctggtgcctgagctcataggagcctgccgggtgcccagacacaaccaggttatgtctgctggagcaggcctggatcctgggtgcctgggggctgtcttggcatcagagtctaatcaagtgggcctgctaactggatttgtaggggcatggaacctgtgtctatggggggctggcctgtcactgggatctactggggtaggcctggtgtctgggtgtctgggatctactggagtggtcctagaggctgcatccgtgggatgggtctagagtctgaatccatgggaactggctggacactggggcaggcctggaactttaatctgcaggagtgggcctgggtttttgatctgtgggagacagactgaagcatgggtccacaggcgtggtcttgggagcctgggcctgttggagtgggcccagcactgggatctactaggcaggcctagatgttgggtctgctggaccctgcctggtgctagggttatcctggagcctggggcttcaggggccagtttggagcctgcagctgtggatgctggcctggtgccttgggttgtatgggccaggttggagtctcattctgtgggcatgggcctggatcctgcatctgtgctggctagcttggaggctggggccacaggagctggcctggtactggtcttgtggtactttttaaaggaagtgtaattcttttataacacaaatgtttggctcttttagctctttaaaaataaacctggatttttttttttcaagagggaaagagtatggcataatggaaggagaaagggactcagagtcagcccaatattaatcatgtctgagccacttattagtggaaagatcttcatcaatttactaatcctctctgtacttttttttttaaatcttggaaatgtgtataataatgccaataatatctctaataacaggggcttcaggattgcaatctgcttagaagagtaggaggctaacatacttatcttaaaaatttatggcaagcatattttctatgcacaatctaagtttatttgggggatttggtggggtaggaaattttggtggaagtaataggaagaaaataccttcacgtcaatcccttagtgctgccagcagaataatgtatttatgtaatcaagactattatgattaagagtagtatatttttagtgagtgctggctatcttctgtatttaattactgaaagagatgaactgtttcaaaatcctctttttctttctagaatgaattccaaccatttaaataattcataatttgaaataacattattcaatttgttcccctattctgatatttaagggtcatgaattgccatgttttccttttcttaaatcaatgtctgtgtcatttacttttactttccttttgataagcagttggacattgatgttataactgaaaaaaatagtctatagcagcgcatctgtaattttcatttcagtttaattgcctaggaatcttgttgactgacgattctgatttagtaggtctaaaggtgggacctgagattctgcatttctaactaactcccagatgctgctcttactagtctatagaccacacttaaaagtggcatgggacttgaaatagtgtaggttatcacaaaattttaaaggtggaaggaactgtacaaagttggtaattcttgggcatacagtgatttcagggtgaggacactaaaacttagagaatccaagggtcttgggataaggtcatgatagctaacagaaccataagaaattcaactcattctatagtttttgtgtgctttctaccacacaccagtgcttcttaagtttcagttatttacatatattatgtaagttcctagataaatctatacagtgaagctgaaatccctggaatgtgctatgttacaattattccttcttcaagtaactgaagacattattaaattatggcaagatttgtcaaccaaagtctcagtgatatctgtacacctacattaaaggaaaatgaatacatatgcaatctgctgtcagaattttaggaatcctgatctttactgttctgataagtctcttctaaaggtgttttagagactgatttttcaatttgattactaaataaagcaaaggaaagaactaaaggaattttgcatgaggagaggacgaatgagatttcactatggacagaattgtgactaaattttaccatatggcctacaatgtctctcccagtcaaggttatatataatgcctctgtactcttctatttcccagtatcatatctggaaccaagacacttggacaggaatcctattttagacagaggactgaaagtagtaaatgtaaatatttttaagacattgcatttgataaggaataaaggaagagtgaatctctgactcatttctcctcaaattattattttgttgtgatttatgaaaattaacaatctgaacaagagaaggaagttatgattaattttggaagattgtaaattgcataccagttttccaatgttagccatttttaatcaactcagtttttaaacaaaaatttataaatatggctgaaccgaagatatctatagagagcttcaacataagatttgatcaagcagaagaaaggatcagtaagctcacagactggttattagaaattacccagtcagaagaacaaaatgaaaaaagaatttaagagtgagaaagtctgtgagaattatggggcagtgaagcaaaccaatctttgcattataggagttccagaaggaacacagagagagaaaggagtagtgaatgtatttaaagaaataatgacagaaaacattcataaactagggacagatataaatgtccacacataggaagctcaaaggtctccagttatgttcagctgaaacaatgctacaataagacttagtaaaactctcagaagcgttaagacaaagagaggatcctgaaagcagcaagagaaaagaagcaaatctcatacgagagaactccattatggctatcattagatttttcaacagaaaccctgcaggtcagggatagagtgaaaaaaaaaaaaaaaaaaagcaaacaaaaatttcttgctcaaagaaagaaaaaaaaaaacaccaggaaccataaagttgtccctcagaaatgaaggagagataaggactttcccagacaaataagaactgaggaagttcactagacttgccttataagaaatgcaaaagggaattctttaagctgaaagaaaaggatggtaattggtaatatgaaaacatataaatgtaaaaaattcactggtgaaagtaagtatgtagtcagattcagaatgctgtatgtaaagctacaatggtggtgtgtaaatcaattatatctttagtaagaaggttaaatataaagtagttaaaataggtatatttacaataattaagtgatatacaatatataaaatgtaaattttgacatcagtaacaatatgttggtgggtaataaaattgtagaattcttgtgtgttattgaagttatcagcttaaaaatagcctgttacaaccgtaatatgttttatgtaagcctcatggtaaccacaaaagaaagagctacagtagatacataggagataagtaagaaatcaaagcataccacaacagagaatcattaaattacaaaggaagacaggtagagtggaagaaaggaacaaaaaatctgcaaagctaccagaaaacaatgaacaaaatggcagttgtatgtctttatctatcaaacaagtagtttaaatgtcaatggattaaattctcccatcaaaagatacagagcagctgaatggattaaaaaaaaaaaagtccaaactatatgctgttaataagagactcatttcatctttaaggacacaaatagactgaaagtgaagaaatgggaaaagatagtctatgaaaatggaaacgaaaagagagcagaggttgttatacttagatgaaatagacattaaataaaaaattgtgagaagaggcacagaagattattatataatgataaaagtgttggttaatcaagaagatacagcaattgtaaacagatatgcacccaatatcagaacacctaaatacataaagcaaatattaatagatctgaagggagagacaagactgcaagacaataatagtataggacttcaatatttcacattcatcaataaacacatcatcgacttagaaaatcaatatggaatttgatttataatttgatatgtggacttcaatcacacagtaaagcaactgtacctaacaaacgtatatcagaatagttcatccaacaacattggaacacacatccttcttaagcatatgctaaacattctccagggtataccacgttagtctagaaaacaaatcgtaacacatttaagaggatttaagtgatatcaagtatcttttttaaccacagtggtatgaaattataaatcattaataggaagaatttcaaaaaattgcaaatatatggaaattaaacaacatgcttctcaataatcagtgggtcaaagaagaaatttaaaggacaataaaacaataccttgacactaatgaaagtggacactcaacatatcaatttgtataggatgcagcaaatcataagagagaagtttatagcaacagatgcctacacataaaagaagaaaaatctcaatctagtgttacacttcaaggaactagaaaaataacacactaagcccatagttagttgaatgaatgaaatattaaaaatcagagcagaaataaatgaagtagaaattataaaagcaatagaagagatcaacaaagctaagagttgtttttttaaaagataaaattgacaaacctttagctagactgaaaaaatagtgaagagttaaagaaaatcagaaatgaaagaggagacattacatcttatatcactggaatatgaaggatcataagagacaactatgagcaatcatatgccaacaaattagataacctaaattcctggaaacatacatcttatcaagactgaatcatgaagaagttgaaaatctgtataaactactaattaaggaagttgaatcagcagtcatagactgcccaaaaaacaacccaggacctgatgcctttactggtgaattctaccaaatatttaaagaataaacaccagtgtttctcaagctctctcaaaaaattgaaaattgatgagagaaaacttcaaactcattttaagaggccatcattaccatgataccgaagtcaaagacactacaagaaaaaaaaatgcaggccaatattgttgatgaagatagatgcagaaattctcaatgaaatactagcaaaccaatacatgaaaaacatcatacaccatgatcaagcaggatttattcctgggatgcatttatgtctgtggttcaacatttacaagttgataaatgtcatacattaatagaataaattacaaaaaccatgtgattatctcaataaatgcagaaaaagcattagagaaactttaacattttttatgataaaaacccgcagcaagttaggtatagagggaatgtacctgaacacaataaaggtcatatatgataggcccaaaattaacgtcatactcaacagtaggaaggtgaagatgtaaaaaaaaaaaaaagatgtaaattactacatgaaatcataaaatattattgggtgatggaataacagtgtagagttactttatgcaatcaaaccaaagttatcagcttaaaatagtctaactgtaagatgtttcatgtaaacctcttgatcactataacgaaaaactatgctagatacacttaagataaaaagtgggaatcagagcatagcactagagaaaatcctctaaccataaaggaagacagcaagaaaggaagaaagaattacaaaacaaccggaaaacaatgaacaatatagcaatagtaaatccttacctataaataattaccttgaatattaatagattaaattcttcaaagaaaagatagtgactgaatcaatcagaaaataagacccaagtatgttctgcctataagagaatcactctcacctttaagggcacatacagattgaatgtgacaggatagaagtagataatccatgctgatggaaaccaaaagaaagcaggagtagctatacttatatcagatgaaatagaatttaaataaaaattataaaaagagacacagaaaaggtcatataatgtaaaggggtcaatttatgaagaagatataacaattgtaaatatatctgcacccaacatcagagtacctaaatatataaagtaaatgttaataaatctgaagaatgagatagactgcaatatagtgtagtagactttagtatgcctctttaaataatgaacagatcatccagacaaaaaatgatatagaacttgaactacatcttagaccaaatgtaacagacgtatatagagcatttcagccttctatccaacagtagcagaatccacatttttctcgagcattttggaaacttccccaggatagatcgtaagtcagaccagaaaataaatctcaacaaatttaagaagattgaaattatgccaaatatcatctccagtcacaatggtatgaaaatagaattcataacagaaggaatattgcaacatttataaatttgcacaaacttacttggccctaaacaaccaagagtaaaactgaaatgggaaattaaagggaaattaaaaatatcttgagacaaatgaaaatactacataacaaaaattatgggatgcaacaaaagcattttattttattttattttattttactttaagttttagggtacatgtgcacaatgtgcaggtttgtgacatatgtatacatgtgccatgttggtgtgctgcacccattaactcatcatttagcattaggtatatctcctaatgctatccctcccctctccccccaccccacaacagtccccagtgtgtgatgttccccttcctgtgtctatgtgttctcattgttcaattcccacctatgagtgagaacatgcagtgtttggttttttgtccttgcgatagtttgctgagaatgatggtttccagcttcatccatgtccctacaaaggacatgaactcatcattttttatggcagcatggtattccatggtgtatatgtgccacattttcttaatccagtctatcattgttggatatttgggttggttccaagtctttgctattgtgaatagtgccgcaataaacatacatgtgcatgtgtctttatagcagcatgatttataatcctttgggtatatacccagtaacgggatggctgggtcaaatggtatttctagttctaaatccctgaggaatcgccacactgacttccacaatggtggaactagtttacaatcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatattctttgcccactttttgatgtggttgtttgtttttttcttgtaaatttgtttgagttcattgaagattctggatattaaccctttgtcagataagcaggttgcaaaaattttctcccaatctgtaggttgcctgttcactctgatggtagtttcttttgctgtgcagaagctctttagtttaattagatcccatttgtcaattttggcttttgttgccattgcttttggtgttttagacatgaagtccttgcccatgtctgtgtcctgaatggtaatgcctaggtttttttctagggtttttacggttttaggtctaacatgtaagtctttaatccatcttgaattaatttttgtataaggtgtaaggaagggatccagtttcagctttctccatatggctagccagttttcccagcagcatttattaaatagggaatcctttccccattgcttgtttttgtcaggtttgtcaaagatcagatagttgtagatatgcggcattatttctgagggctgtgttctgttccagtggtctatatctctgttttggtaccagtaccatgctgttttggttactgtgtccttgtagtatagtttgaagtcaggtagcgtgatgcctccagctttgttcttttggcttaggattgacttggcaatgcgggctcttttttggttccatatgaactttaaagtagttttttccaattctgtgaagaaagtcattggtagcttgatggggatggcattgaatctataaattaccttgggcagtatggccattttcacgatactgattcttcctacccatgagcatggaatgttcttccatttgtttgtaacctcttttatttcattgagcagtggtttgtagttctccttgaagaggtccttcacatcccttgtaagttggattcctaggtattttattctctttgtagcaattgtgaatgggagttcactcatgatttggctctctgtttgtctgttattggtgtataagaatgcttgtgattttttgcacattgagtttgtatcctgagactttgctgaagttgcttatcagcttaaggagattttgggctgagacgatggggttttctagttatacaatcttgtcatctgcaaacagggacaatttgacttcctcttttcctaattgaataccctttatttccttctcctgcctgattgttctggccagaacttccaacactatgttgaataggagtggtgagagagggcatccctgtcttgtgccagttttcaaagggaatgcttccagtttctgtccattcagtataatattggctgtgggtttgtcatagatagctcttattattttgagatatgtcccatcaatatctaatttattgagagtttttagcatgaagggttgttgaattttgtggaaggccttttctgcatctattgagatgatcatgtggttttcgtctttggttttgtttatatgctggattacatttattgattttcgtatgttgagccagccttgcatccccgggatgaagcccacttgatcatggtggataagctttttgatgtgctgctggattcggtttgccagtattttattgaggatttttgcatcaatgttcatcaaggatattggtctgaaattctcttttttggttgtgtctctgcccggctttggtatcaggatgatgctggcctcttaaaatgaggtagggaggattccctctttttctattgattggaatagtttcagaaggaatggtaccagttcctccttgtacctctggtggaatttggctgtgaatccatctggtcctggactttttttggttggtaagctattaattattgcctcagtttcagagcctgttattggtctattcagagattcaacttcttcttgatttagtcttgggagggtgtatgtgtccaggaatttatccatttcttctagattttctagtttatttgtgtagaggtgtttatagtattctctgatggtagtttgtatttctgtgggatcggtgatgatatcccctttgttattttttgtcacgtctatttgattcttctctcttttcttctttattagtcttgctagcggtctatcaattttgttgatcttttcaaaaaaccagctcctggattcattgattttttgaagcgttttttgtgtctctatttccttcagttctgctctgatcttatttatttcttgcattctgctagcgtttgaatgtgtttgctcttgcttctctaggtcttttaattgtgatgttagggtgtcaattttagatctttcctgctttctcttgtgggcatttagtgctataaatttccctctacacactgctttaaatgtgtcccagagattctggtatgttttgtctttgttctcgttggtttcaaagaacatctttatttctgcctccatttcgttatgtacccagtagtcattcaggagcaggttgttcagtttccatgtagttgagcagttttgagtgaggttcttaatcctgagttctagtttgattgcactgtggtctgagagacagtttgttataatttctgttcttttacatttgctgaggagtgctttacttccaactatgtggtcaattttggaataggtgtggtgtggtgctgagaagaatatatattctgttgatttggggtggagagttctgtagatgtctattaggtctgcttggtgcagagctgagttcaattcctggatatccttgttaactttctgtctcgttgatctgtctaatgttgacagtggggtgttaaagtctcccattattattgtgtgggattctaagtctctttgtaggtcactaagaacttgctttatgaatctgggtgctcctgtattgggtgcatatatatttagggtagttagctcttcttgttgaattgatccctttaccattatgtaatggccttctttgtctcttttgctctttgttggtttaaagtctgttttatcagagactaggattgcaaccccttcctttttttgttttccattggtttggtagatcttcctccatccctttattttgagcctatgtgtgtctgcatgtgagatggatttcctgaatacagcacactgatgggtcttgactctgtatccagtttaccagtctgtgtcttttaattggagcatttagcccatttacatttaaggttagtattgttatgtgtgaatttgatcctgtcattatgatgttagctggttattttgctcgttagttgatgcagtttcttcctagccttgatggtctttacagtttggcatgtgtttgcagtgggtggtaccagttgttcctttccatatttagtgcttccttcaggagctcttgtagggcaggcttggtggtgacaacatatctcagcatttgcttatctgtaaaggattttatttctccttcacttatgaagcttagtttggctggatatgaaattctgggttgaaaattcttttctttaagaatattgaatattggcccccactctcttctggcttgtagagtttctgcaacgaaagcatttctaagagaagtttatagcaataaacacacagatcaaaaataagaaagatcccactaaaacagtctaatgctgaacctcaaaggactagaaaaaacaacaatataaatccctagtttatagtagcaaagaaaaaaacaaaggtcagaacagaaataagtgaaatagagactgtaaaacaataggaaagatgaacaaaacagaattgattttttcagaagataaacagttgacaaacttttaactaagaaaaatgacagaagactgaaatatataaaataaaaaatgaaagagtaggcaatacaggagataccacagaaatacagatgacaagagactactgtgaacagttatacacaaacaaattacataacctaaaacacatggatgagatcctggaaatgtacaactaccaagaatgaatcatgaagaaatagaaaagctttacataataacaagtaaggagattaagtcaataataaaaaatagctcttatgtgaaaaagttcaggacttgatggtttcacatctgaactttacaaacatttaaagaagaagtaataccaatgcttctgaaattcttccaaaaaattgaggagtagataaatctttcaaactattttaagaggcctgtatgaccctgataccatagacaaacaagtatattataagaaaaaattaccagccaatattcctgataaacagatgcagatattctcaataaaatactagcaaattaaattcagtaacacattataaggatctgttgtcatgatcaagttggatttatttctgggatgcaagtttggttcaacttatgcaaatcagtggaggtcatacactacattaacaaaaagaaggacaaaaatatggctatctgaatagatgcagaagaggcatttgacaaaatctaaaatattaagtaaagaagattatattagtccattctgacattactataaagaactgtaggagagcagccccagtgcttatagataaaactcccatctccctaggacagagcacctgggggaatgggcggctctgggtgcagcttcggcagacttaaatgttcctgcctgccagctctgaagagagcagcagatcccccagcacagcattcgagctctgctaagggatggactgcctcctcaagtgggtccctgaccctcatgcctcctgactgggagacacctcccagcaagggttgacagacacctcatacaggagagctccgggtggcatctgccaggtgcccctctgggacgaagcttccagaggaaggaacaggtagcaatctttgctgttctgcagcctccgctggtgatacctaggcaaacagggtctggagtggacctccagcaaactagagcagaccttcagcagaggggcctgactgttagaaggaaaactaatgaacagaaaggaatagcatcaacatcaacaaaaaggatgtccaccaagagaccccatcctaaggtcaccaacatcaaagaacaaagatagagaaatccacgaagttgaggaggaaccagcacaaaagactgaaaattccaaaaaccagaatgcctcttctcctccaaagtatcacaactccttgccagcaagggaacaaaactggaatgagaattagtttgatgaattgacaaaattaggcttcagaaggtgggtaataacaaacttctctgagctaaaagagctgttctaacccaatgcaagaagctaagaaccttgaaaaaaagttagatgaattgctaactagagtaaccagtttagagaagaacataagtgaccttatggagctgaaaaacagcacaacaactttgtgaagcatacacaagtatcaataggcgaatcgatcaagcggaagaaatgatatcagagattgaagatcaacttaatgaaataaagtgtgaagacaagattagagaaaaaagaatgaaaaggaaacaagcctccaagaaatatgggactatgtgaaaagaccaaacctatgtttgattggtgtacctgaaagtgacagggagaatggaaccacactggaaatcactcttcaggatattatccaggagaactttcccaacctagcaagacaggccaacattcaaattcagggaatacagagaacaccacaaagatactactagagaagagcaaccccaagacacataatcgtcagattcatcaaggttgaaatgaaggagaaaatgttaagggcagccagagagaaaggtcaggttacccacaaagggaaggccatcagactaacagtggatctctcagtagaaatcctacaagccagaagagagtgggggccaatattcaaccttctgaaaaaaaagaagtttcaacccagaattgcatatccagccaaattaagcttcataagcaaaggagaaataaaatcctttacagacaagcaaatgctgagagattttgtcaccaccaggccttcctcacaagagctcctgatggaagcactaaatatgggaagaaaaaaccggtaccagccactgcaaaaacataccaaattgtaaagtctttcgacactatgaagaaaccgcatcagctaatgggcaaaataaccagctagcatcataatgacaggatcaaattcacacataatatttatataaccttaaatgtaaacaggctaaatgccccaattaaaatacacagactggtaaattggataaagagtcaggacccattgatgtgctgtatttaggagactgatctcaatcctagtctctgaaaaaacagactttaaaccaacaaagataaaaaaaaaagacaaagaagggctttttacatttttacaaagaagggctttaccattacataatggtaaagggatcaatgcaacaagagctaactatcctaaatacatatgcacccaatacaggagcacccagattcataaagcaagttcttagagacctacaaagagacttagactcccacacaataatagtgggagactttaacaccccactgtcaatattagacagctcaatgagacagaaaattaataaggatattcaggatttgaactcagctctggaccaagcggacctaatagacatctacagaactctccacccgaaaccaacagaatatacattcttctcagcaccacatttcacttattctaaaattgaccacatagtggaagtaaaacactcttcagcaaatgcaaaagaatggaaatcataatagtctctcagaccacagtacaatcaaattagaactcaggactaagaaactcactcaaaaccgcgtaactacgtggaaactgagcaacctgctcctgaatgactactgggtaaataacaaaattaaggcagaaatcagtaagttctttgattcctatgaaaacagacacaacatagaggaatctctgggacacagctaaagcagtgtttagagggaaatttatagcactaaatgcccacaggagaaagcgggcaagatctaacatcgacaccctaacatcacaataaaagaactagagaagcaagagcaaacaaattcgaaagctagcagaagacaagaaataactaagatgagagctagagacacaaaaatcccttcaaaaaatcaatgaatcaggagttgcttttttgaaaagattaacaaaatagatcgaaagccagactaataaagaagaaaagagagaagaattaaacagacattataaaaatgataaaggggatatcaccactgatcccacagaaatacaaactaccatcagagaatgatataaacatctctactcaaataaactgcaaaatctagaagaaatggataaattcctggacgcatacaccctcccaagactaaacctggaagaagttgaatccctgaatagaccaataacaagttctgaaattgaggcagtaattaatagcctaccaaccaaaaaatacccaggaccagacagattcacagccaaattctaccagaagtacaaagaggagctggtaccattccttctgaaactgttccaaacaagagaaagagaaggaatcctccctaactcattttttgagaccagtatcatcctgataccaaaacttggcagagacacaacaaaaaaagaaaatttcaggccaatatccctgatatgaacatcaatgcaaaaatcctcaataaaatactggcaaaccgaatccagcagcacatcaaaaatcttatccaccataatcaagtcggctttatctctgggatgcaaggctggtttaacctatgcaaatcaataaacacaatccattatgtaaaccgaagcaacgatgaaaaccacatgattatctcaatagatgcagaaaaggcctccgataaaattcaagagccttcatgctaaaaactctcaataaacttggtattgatgaaacatatctcaaaataataagtgctatttatgacaaacccgcagccaatataatactgaatgggcaaaagctggaagcattccctttgaaaactggcacaaggcaaggatgccctctctcaccactcctattcaacatagtattggaagttctggccagggcaatcaggcaagagaaagaaataaagggtattcaaataggaatagaagacgtcagattgtctctctttgcagataacatgactgtatattttgaaaaccccatcgtctcagcccaaaatctccttaagctgataagcaacttcagcaaactctcaggatacaaaatcaatgtgcaaaaatcacaagaatttctatacatcaataatagagaaacagagagtgaaatcttgagtgaactcccattcacaattgctacaaagagaataaaacactaagaatacaacttacaagggatgtgaaggacctcttcaagtacaactacaaaccactgctcaaggaaataagagaggacacaaagaaatggaaaaacattccaagctcatggataagaagaatcaatatcgtgaaaatgaccatactgcccaaagtaatttatagattaagtgctatcccaatcaagctaccattaactttcttcacagaattagaaaaaactactttaaatttcatatggaaccagaaaagaggctatatagccaagacaatcctaagcaaaaagaacaaagctggaggcatcatgctacctgaattcaaactgtactacaaaggctacagtaactaaaacagcatgttactggtaccaaaacagatatataggctaatggaacagaatggagtccttagacatatcaccacacatctacagccatcttatctttggcaaacttgacaaaagcaatggggaaacgattccctatttaataaatggtgttgggaaaactggctagccatatgcataaaagtgaaactagactccttccttacacctcatacaaaaattaactcaagatggattaaatacttaaatgtaagacctaaaaccataaaaactctagaagaaaacctaggcaataccattcaggacataggcatgggcaaggacttcatgtctaaaacaccaaaagcaatggcagcaaaagccaaaattgataaatgggatctaattaaagtaaagagcttctgcacagcaaaagaaactatcatcacagtgaacaggcagactacagaatgggagaaaatttttgcaatccatccatctgacaaagggccaatatccagaatctagaagaaacttaaacaaatatacaagaaaaaaaaaaaaaccccgtcaagaagtgggcgaaggatagaacagatatttcccagaagaagacatttgtgtggccaaaaaacatatgaaaaaagctcatcatctttcgtcactagagaaatgcaaatcaaaaccacaatgtgataccatctcatgccagttaaaatggctatcattaaaatgtcaggaaactacagatgctggagtggatgtggaacaataggaccacttttacactgttggtcagagtgtgaattagttcaaccattgtggaagacactggtgattcctcaaggatctagaaccagaaataccacttgacccagcagtcccattactgggtatatacccaaaggattataaatcattctactataaggacacatgcacacatacgtttattgcagcaatattcacaatagcaaagacttagaaccaacccaagtgtccatcagtgaaagactggataaatcaaatttggcacatgtacatcatggaatactatggagccataaaaacgatgagttcatgtcctttgcagggacgtggatgaagctggaaactatcattctcagataactaacacagaaagagaaaaccaaacactgcatgttctcactcataaatgggagtcaaacaatgagagcacatggacacagggcgtggaatatcacacactggggcctgtctgggggttgtgggctagggaaaggatagcattaggagaaatacctaatgtagatgacaggttgatgggtgcagcaaaccaccatagcatgtgtatgtatacctatgtaacaaacctgcacgttttgcacatgtatcccagaacttaaagtatttaaaaaaaaaaaaaaacaaacaactgtccgatactgggcaatttatcaataaaagaggtttagttgactcacagttctgcatgcttgtggagccctcaggaaacttacaattatggcagaaggggaagcaggcatgtcttacatggcatcaggcaagagagcatgtaatggaagcaaagggggaagagccccttataaaaccataagatcttatgagaactcactatcatgagaacagcataggggaatccatgcccaagatccagtcacctcccaccaggtctctttctcaacacccagggattacagggattacaatttgagatgagatttgggtggggacacaaagccaaatcatatcaaagatttacctctaaacataataaagacaatataccacaagcccatagtgagtattatgctcagcactgaaaagttgaaggcctttttcctaagatgaggaacaagacatgggtactcaccctcacttttgttcaacacagtactgaaagtactaaccagaacagttaggcaagtcaaagaaataaaaaggattcaaattggaaaggaagaagtaaaattgtctttccttatagataacataaccttatatatagaaaagcttaaagactccaccaaaaacctgttaaaattgattaataaattccataaagttgtagattacaaaatcaacatacaatttttagtagcatttctatacagtaacatcaaattgcctcaaaaggaaattgagaacacaatcctatttacagtagtttcaaaaataaattaggtataaatttacccaaagaggtaaaaactctgtaagcagaaaactataaaccatttatgaaagaaatttagggagataaaataaaaggaaagatatcccatgttcatgaattgaaaggatgaacattgttaaagtgtctctacttcccaaagttatctacagattccatgcaacccccgtcaaaaactccaatgacatattccccagaaatagaaaaaaaaaatcctaaaatttgtatgacatcacaaacacttcaaaatagctagagcaatgttgagtaaaaaggataaaactggaggcctcatagtgcgtgctttgaaaatctactacaaagctgtgttaatcaaaacagcatggtgctggcataaaagcagacacacagacttacaggatagaatggaaaagccagaaaaaaatccacacatttatcgccaattgattgttgataaaaacgccaagatcacacaatgggggaagggcagtctcatcaataaatggtcgtagggaaactgggtgttcacttgcagaagaataatattagactcccatctcacatcatatatatataaatcatctcaaaatggattaaatgcttaaatgtaagacctaaaactgtgaaagtagtaaataaatcataggagaaaagctctctgtcattggtatgatcacacgtactttggatataacccccaaagcacagacgacaaaagtacaaatagacaaataggatgacatcaaactaaaaagcttctgcacagcaaaggaaacagaatgaagagaaaacctgtggaaaaggagaaagtatgtgagaccatatgtctgataaggaattaatatccagaatatatgaggaacttgaaagtaagaaaacaatctgatataaaaacatgcaaaggacctatataaacatttttgaaaataagacatataattggccaacaggtttatgaaaaagtgatgaacattactgatcatcaggaaaatgcaaattataactctaatgagatactgtcttatagctgttagagtggctactttaaaaaagaccgaaggtaagtattagcaaggttatggagaaaagagaacccttgaagactgttggttgggttgtaaattagtattacagccataattgtaaacagtatggaggtatctcaaaaataagaagtagaactatcatgtcatccaacaattttactatttagtgtatgtccaaaggaaatcatatcagtatctcaaagagatgcctgtatttctgtcacggcatccttggagtgttacttttctagctgggaacctctgtggctggtattgcctttgtctgaattttgcttgggcctgcttggcttgttctgcctactctgcctggcaggatacactctgctcgcactaacagcctgccaagggtgagccaggtacggagtggtgaggggtgtgtgagttagcgtgtgatctggccactgcacacagccaggcacactagttgtggtgtggtggacagctccaggtgccggcaccctgcaaggctgtggctcaatgaggcttactgcaagcagcttccatggctgccactggggtaggcagtggtgcctggaagcttggagacttcaggaactgcagagccccattgagggtgtcacagctctggcttggggagctcttaagtctgggctccctgaagtgctacagctcttctctccttcttgtcacctgcaacgtggcaagcaaggggcgtgtttcagccctgtttgtgttactgctctttcagtcgtgccgttccgcaggtcctgagttcttgtcctgtgtccaggaagaatgagttatgtggacaagtggagggtgaacaaggtgaagagatcctttattgagtgacagaacagcttaaaggagacccacagtgggtagctcctctctgcaggcagggcatcctgacaagtgttcagctctcagcagagaggagacccatagtgggtagcttctctccacaggcaggttgtcccatcatctgctcagctctcagcagagaggagaccctcagtgggtggctcttttctgctggcagattgtcctgtcatctgcttgagtttggctgagtccagggtttctatgggcttcagaggggaggaagtgcatgctgattggtccatggaaagccatgggcaggcccagaaaaagcaccagaagttctccctccagtccatggcactggcagtccagtccccaaacctcaggctgtctctgacctgaagatgaggtttcaccaggtacctgcccctttccatctaggcctgtctgcctcctgctgccattaacctgccatccacggtgcccatggtgcccaggctgtttgtgctgaatgttgcctgcaggcctgcatcaagccactcttagccccctgtcagcctttctcccatcctctttggtacccaaagtctggagggggccaaggcatgagggggctggtgtgtcatagctgccctgaatgtgtgcacacctggctgattcatgacagtgcccaggcttggccacaactttgcttcaaaattggagcgggtgtttgtagtgggtgcttggagtggggagaggctaggcagcaggagcagtcacttacaagcttgtgggtcagcagggcttcctgggtccccaagagtgtagagatgcccgggtttgcagccacagcttgacggctacaactgcgcccggggggcggggctcccacctgtttaacttggaatgggctgggagcttccacctgttcttggttcctgctggctccgtggagtgcacagccccagctgtgcctcccccactgcatctggtgtcattgatgatgccagggattgattgacaccattccagacaggctgccgctgccttcagtccctgctctgaagaggtacatctgctgccattaggatagggacaatgactgctcttaactgcttcatgctgacagggggcattgtttatggggaaaatggcagttatgtcttcttagaggccctatctaagggtccctagtaaaagtaaaagggagccatcagccaagtttccatttgcatgaccatttggagtttgatggcccgaaggcgagaagagacaaaccgggttattggaagacatggatcaaaacaaaacaaaggggtaaggacagctcaaaaaccctgaggctactcacatgctcaaaattagaatattgatccagattttttatattacgcatcccttttgtctcttctgagccgtagtcagaaatcactggttggttcacaagagcaagctgggttagtctaaaatgcagaccaaaacttaaaaacaaagtccggagggggctgaggcagcatggagctggcgtatcagcactgccccaagcgtgcacatacccagctatgtcatgacagtgcccaggcttggccacaacgttgctccaaaattagagtgggtgccaggagtggggagaggccaggcagcaggagcagactcttgcgagactgcaggagtgtcttcctaggcccttgagagtgcagaaatgcctgggtctgcagctgtggctgggtggctgcagctgcacccaggagggtagggctcctgccccttcaacttggaagtgggcagggcttccacctgttcctggctcttgcagctttgtggagtccacaagctccagccttacctcccacactgcagctggcatcatggcagtggccactccagatgccccactactaccatcacttccatgttcattgtggcgttatttccaatagccaagatgtggaatcaatctaagtgtccattaatgggtgaatggatgaagaaaacatgttatatatacacagtgaaatatcattcacccttaacaaaagaaggaaatcctgtcattctcaacatcatggatcaacctgtaggacattatgttaagtgaaataagtcaggcacagaaagacatactcatgatcttacttattataagtgtagtgtaaaaatgttgacctcatagaaacagtgaaatgttgattatcagaggctagggtgtgggaggaattagggagatgttggttaaaagacagaaaaatttatttaaagtggaggaataaattcaaagacttgtaaatcatggtgactgcagttaataacaatatgttgtatatttgaaaattgctaagacagtagattttaagtgttcgtaccagaagaaatgataagtatgtaaggtaatgtatatgttaaatagcttgatttagccattctacaggtatcaaagcatcatgttttatattataaatatatataatcagttaaaaaaaagtactgagactctgagaaaggcattagttaatttgcccatagttttatatttagtgaatccagtggtcttacttcagatgtgtattcttagccaaaagatgcacttgctttcacctccacttctgtccctaaaaactgaaaagcaaaataaagaggtggaaagaggctgggtgcggtggctcatgcctgcaatcccagcactttgggaggccaacatgggcagatcacgaggtcaggagttcaagaccagcctgaccaacatggtgaaaccccatctctactaaaaatacaaaaattagctgggcgtggtggcgcatgcgtgtaatcccagctactcaggtggctgaggcaggagaatcgcttgaccacggaggttgcagtgagctgagatcagcgccactgcactccagcctgggctacagagtgagactctgtctcaaaaaaaaaaaaaaaaaggaaagaaattcagtagccatttcattcagccttgcagttgatgcagtctttagctaaacactgggatagtttgggagggaaggccgtagtttgggagggaaggccgttagtacaatttttttatacgttgtgcataagaagcttttgagtcatggatctttgataattactttcagtagtaacgtatcctcggtaattttttttactttcagtaataacatatcctagacaaattttatgcatttttttccatacttgaaagaaactttttattaaaaaatagtattaataacggagcataatctggtaggagtgttcattactactgttttattgtttttaagttttttccatgggtagagtaggaaacacgcatttttggagagaaaaacatgaatcccaaatttatcctcattccaatttaagataaagattttgagggattttatttaccactttggtcttaccctttttgtatatctttttcttttattatccttttacctctgttctctgattttacatttttttttgcattttttttttttttttgctagatgcaggcctaggtattttattttacttttcgttatacagtcttctcgattattttaactaagcaggtttttttggatggtgggaggagaaggagaaaacattaagttgtctgcttcttatttattttacatattgcttataattctcttgtgaattattttagggtttttattggttgtttttgtttttgccttcctgatataaaaattatattgcttgcaaataaagattactttccttctttttcttccatttttggcctctaatgttttctttacttgtgttgtttaagatattaaataatagaagagatagtggacatccttgtcttattccttattttaatgagaaagtacctaacatttccaatttagtaagttgctggctaattgggaagtacagacacatgtgtatatctatatatctgtatatctatatctatatctatatgtattcaggctaaaaaatacctcttaatttctatgtaaacgttaaaatttttattttggtaattatgtatgatgttgaattatgtcacttgaatttttagcagttatgaaaatgaacatataatcttctgttaatataatggattttattaatgcatttttaatattagaaacctttgaatttctggcatgtacccctctttcaaatgttttttagtgttttggattcttttgcatattatctcatttaaagtttttgcatcattattcttcagtgtgtttgatttgtacagttttctgtgcagttttgtgaagttttggggccaatgttatatatctgttatataaaaataatttggaaattttcttcctttttaaaacctagtccttatttttattttattcaggcactgttttaacagatgatcaagtacctaccatgtgctattaacaataaaattgtaatggtagttaatagttccttagctcttaactatatatttgtcagtattctaagtacagttgattctcactgcttgaagtagatttgttctgtgacgtagcagtgaataataaattagctcttactggaattacaatgttaggttcctgtaagcctctggtcacaacatttttgttcacctatcaatacgtaacttttaaaaaatgtgtatttctgtttaaagacaacttatttaaaatatgtattgttgattcattaatattgaactcatgtcccacagcagtatgactcatgcctgaaggaagcttttgtaacacacatattttctccttaaggcatatcacaggcgtcttgtgcttaggaacactagatagcacttgggcattctaaatagccaaatcatcaacaaaaagcacaaaaatgagaacattgttgcacttaatagactgtgaaaagaataatcctttatagtatgagagcagaaacaaagcagagcatttgttcagtttcagctgataggatgcaaatcaggtgactcaaaattctcctcctcctgcacatttccacaaattattgccaaagtgctacgaatattgatgttgggatacaaataaattttattgagtagacaaattcataaatgcggaatctgtggatgaggattgatcgtatttctttgtatttaatatgtgttcatttattggtcatagcaatcctatgaggtaggtattataacacatactatacaataaagaggttaagttccttgtacagtgttgaacaatcaatgagtgtttgaggacaccaccaaagtagtataactgataccaagacatgttgtttacccttaggagctatttctatctaaaagcgttaaaggtgttttgctcaaataactaaatttaaggtagtttgaaataagtagcataagtgtagtgctaccaagatgtagtggatattcagagggaagattattttggagaccacggaaaggctttaggtgatggtttctaaatggaggcttttagaatcaataagatttcatcaagttggcttatgaggatgtaggagatgaactatttcagaaggtactcattttttacatcaaatacgttcaatgattctagtcttttgggaataggaaagtgatggtgaaggggcaacctctttagttttcagttttcgggattcatatactcactctatgaccattttttccagtactatttaaaaatttattctgcctttgtaatactgggaactaaagcatagcaccattaattggaagtcttaaagatgaacaaggcaatgttttaatgtaaatgtatgattttcttattatggaagaagaaaaaccaataatagattgacatttgtgcaataggactgcaaatagtgggtgttttgtgggagaaaaaattgtttcccaattttttgggaaaaattcaagtaaatattaaaaattgctgaaatacaaagattttcccccatatacaatacttttgtaatatactcatcatgtttttcaatgcatctcattagccatacctcttaactgcattgtaaaaaccaaaaaattaagagggaatattttaaaccaaatattctaacttcaataggcatcatagtgattatcatttcagatttggtgtccttgtaactgggctgatttatcataggtggtggatgtgtaaacttacctgtgtatgatcttgttgagggcaagaattgtggcttttcattttttgcgtttctgataaccagcaaagttcctatcacatagaaagccctcaggaaatgttactgcctacctaaatgaatactccaaaaccctttatgactaataatttctatgtaaatattgtagattgtgttgatcagtgttcttccattctatgtattaatgttttattttcagtgcaacactgtgagagtgatcaaagtgcaaaaatcctgtccttatatttagctttataatcagaaaacaccatactaatccataattttttttcacaccattggcctgcttttctttttattgttagttttgtttttattgtcagagaatgttaggtaatttcccagcataactttctcaagaatatatttcctcattactgcagtgaataactcagtgatgtgaaattagaagataacctattctgtttcagcaccagtgctttgacacatataacttgaaatgtgaatacgaattttgttttttcatgttaaaggattcaatttttcatcagttacttagatcttcataaaatctgaagttaggaaggaactttactaattattaagtcctattccattttaatgcctgcaatagtaaatgtttatttatgataaaactctgattaggtagtagggaaaattcaaggtcaaaagtacaaatttctaccaaactaaagaaagaatatgttaatatgacttgcaagcttggattcatatatattaaggaggggggtggaagatgacagttttaagaatcacatagtgttcaacaaaaagccaataaaaagtcctctctgtgccaagagttattgaacattttgaaataagagttataaattaattcatatatttcaatattatcaacatttgctcttggtcaagttcccctcctctcccaagaagagattgttttttgatccagtgttcaattttggttctctccgttaaacatatcaagcttacaagactaagataggtgtcactgagaatgtattttattaaaaacaattgaaaaaattgtattcttaaacatgggatcatatttggagtcttggtgtctatgaaatcctcctggtacaaaatttatatatggataaaaactaaaacagtaggattttgaaatcttttaacttttagattacaaaaagaatatgggaaatacagaaacacacaagaagcaagttttaaaatccctgtaatccctctatccagaaatagtaatattttgatgtatacattttcagggtttttttgtgtgtgtgtggtgtatgcacacacatctatactattttacaaactttgaatcataccgtacgaacacttttgttccttgcttttttcaactttgtgaacattttcctatgccaccaaaaatttagttcaaagtcatttaaaatggttatataattttccactgaatgcctgtatcataagtgatcttcagcagtaggacattagatatatagatatatccagttttcaattatgaactgttatgctaagtatttttatgtagctttttatacacaattcctatttttgtatggtgaagggaatgggattttaattcttatattgaatgtaccttgcaactatacttctgttttatcttagatattatcaaatgatatatttaaatatttatcttggtaaataaatacttgataagttaggtcacttttgtcacaaacaaaatttttaattttttattctatttctacataggtcagttgtagttgtaatgaaggaatcataattcctcaaatctaaaaattagaaagatggaaactgatatttcttcacatttaatagtttgattatacatcttatgattaatgttagtattatctgagacaaatatttcactgtcctttatgtaaagttctttatgtacattgtccactatgacaaaatatgtctcttaatttaggtcttggggaatgaacacttgtttttaatattagcctatcagagtaagcactttaattggattagctcatttaattctcataacattgcatgaactataggtagcattttatcctattttatacatgaggaattctgactcatagagtcctcatgtgtcatagagtcctttgtagagctgcaaagtataggcagtaatataggtggtagtatcatgattgatttgtaggaactctgttactggcacctgcatttgtaaacatctacagcaggaatgtatgccatttaatgcttttgttttttttcttctactctaattgaagattattttccaaagttattctcttaacaaaaattgaaaaatatactatatagaatatgtatatagatatttgtatgcatatgtatgtgtacgcattcgggtatgaatagaaatccacaaacctaactgaatagttgctttgcagacacttggttatgaaacactatccactgaccgaaatattttttctggctataattttggagtataattaaaatataaacttgtaagttcctctttttaaaaagatactttagaaaaacagattttactcttttcattagaaaaatattccaatatgtaacagtatatatactcagaaatgcatatgtctgatttaaaatgatttattctttagttttaagcctatgtatatattttaaaaataatttcttattttaggttcgggggtacatgtacagatttgttacatgggtatattgcatgatgctgaggtttgggatatagatgatcctgtcacccaggtactgagcataatatctgataggtagtttttcagcccatttccccctccctcccccctccctcctttagacaactctaaatgtctattgttctcatctttctgtccatatgtattccgttatttaggtcacgcttacaagtgagaacatacagtatttggttttctgttcctgtgttaattaggataatggcctccagccacatccatgttgctgcaaaggacacatttcagtctttttatggctgcgtagtattccatggtgtatatgtgccacatttgctttatcgactctaccatcgatgggcacctaggttgattccatatctttgcgatcgtgaatagtgatgcagtgaacatatcggtgcatatgtctttttttaggataatttatttgcctttgggtatatacccagtaatgggatggctgggtcaaacagtagtcctgttgtaagtttttgagacatctctcaactgctttccacagtggctgaactaacttgcattcccaccaagagtgtatatgtgttcccttttctccccaggcttgtcagcatttattattttttgactttttaataatcaccattctgactggtgtaagatggtatattgttgtagttttgatttgcatttctctgatgattagtgatgatgaacatttttcatttatttcttggccacttacaatgtcttcttttgataagtgtctatatcctttgccgattttttttttttttttttttgagacggagtctcactctgtcgcccagactggagtgcagtggcaggatctcagcttactgcaatctctgccccccaggttaacaccattttcctgcctcagcctcccgagtagctgggagtataggtgcctgccaccaagcccggctaattttttctattttgtttagtagagacggggtttcactgtgttagccaggatggtctcgatctcctgacctcttgatctgcccgcctcggcctcccaaagtgctgggattacaggtgtgagccaccgcacctggccccattttttaaaggagttatttgttttttgcttgttgatttaagtttcttatagattctggatattagacctttgtcagatgcatagtttgtgaatattttctcccattctctaggctgtttactgttgataatttatttttctgtgcagagctatttagtttaattaggtcccacttgtcaattttcatttttgttgcaattgcttttggggacttagtcataaattctttgccaaacctgatgtcaagaagtgcatttcctaggttttcttgtaggatttttgtagtttgaggtcttatctttacatctttaatccatcttgggttaatttttgtatgcggtgaaaggtagagactagcttcattcttctgcatgtggctagacagttatcccagcaccatttattgaacagggagtcctttcctcattgcttccttttgttgactttgttgaaaatcagatggttatgggtgtatggctttatttctgggttctttgttctgttccattggtctatgtgtctgtttttgtaccagtcccgtgctattttggttactatagccttatagtatagtttgaagtcaggtagtgttctttttgcttagtattgccttggcgatttgggatctgcttttgttccatgtgaatattagaataggcttttctaattttgcaaaaaatgatgttggtagtttgatagaaatagcattgaatttataaattgctttgaccagtatggccattttaacaatattgattcttccaattcatgggcatggaatatatttccatttatttgtcttgtctctcatttatttcagcagtgttttgtagttcttgtagagatctttcacctctttggttagatgtatgcataggtttttgctattggaaattggtgtgtgttcttgatttggctctcaggtagaatgtttttggtgtatagaagtgctattgatttttgtacattgattttgtatccttatttatcagttccaggagccttttggcagcatctttaatgttttctaggtatggaatcatatcatcactgaagagaggtaatatgacttcctttcctatttgaatgtattttatttctttcttttgtctgattattctgactagcactttcagtactatgttgaataggagtgttgagagtgggcagccttgtctcattctagttctcaaggagaatgactccggcttttgcccattcagtatgatgttggctgtgggtttttcattgtgagaatgaataataagaatgaataaggtttttcattcttattattgtgaggtatgttccttcgaagccttgtttgttgagggtttttatcataaagagatgttggattttgtagaaagctttttcttgtctattgagatgatcatatgctttttgtttttgattctgtttatgtggtgaatcacatttattgatgtgcatatgttgaaccaaccctgcatccaagaatacagcctactcgatcatggtgaattaactttttaatgtgctgctggattcatttcgctagtttttttttgtatttttgtgtttttttttgtttttttagggttttgtgtttgtgttcatttgggatattggcctgaagttttcttttttgttgtgtctttgccagattttggtatcaggataattctggccttgtagaatgagttagggagcagggggagtccctcctcctcaatttttttgaatattttcagtaggattggtgccagttcttatttgtatgcctggtagaattcagtgtgaatccttctagtccatggctttttttttgttggtaggtttttaattactgactcaaatttggaacttgttattggtcttttcaggttttcactttcttcctggttcaatctttggaggttgtgtgttcccataaatttatttcctctagatttcttatttgtgttcatagagatgttcataatagtctctgaggatgttttgtatttctgtgggatcagttgtaatgtcatctttgtcatttctgtttgtgcttatttggatcttccctttttctcctttgttaatctaatgagaagtctgtcaatcttttttattcttccgataaacctactcttctttccattgatcttttgtatggatttttgtgtcttaatttaattcagttctgatcttaattatttcttttcttttattagctttgtggttttttttttttttctagttcctctaggtacaaagttagattgttaatttgagatctttctaatttttgatgaatgcatttggcaccgtaaactttcctcttaacatgctgtagttccatcccaaagattttgttaatatgtggttctgtttttgtgaatttcgaatagttttttggtttctgccttcatttcattatttccccaaaacttattcaagagcaaattccttccttttcatgtatatgtgtagctttgagagatcttcttggtgttggtttttgtttttattgcactgtgatgtgagaacgtgcttaatatgattttgatttttttgaatttattgagacttgctttatgaccaaaacatttggttgatcttagaatatgtttcttatgcagatgagagaaatgtatattatgtgattttgggtggactattctatagatgtctattaggtcccattggtggactgtcaagattaagtctggaatttctttgttagttttcttcctcagtgatctgtctaatcctgtcactggggagttgacatctcccagtattattatgtggctattgaggtctttttctaggtcaaaaaggacttgttttatgaatctggatgctccaatgttgggtgtgtatagacttaaggtagttaagtcttcttgttgaatggaaccctttgccactatgtaatacccttgtttgcccttcttaattgttttcagtttaaagtctgccttatctgatattagaattgcaactcctgctctttattgttttccatttgtatggcagttctttttccctttaattttgaggctttcggtattgttacatgtgagatgcatcttcttgaagacagcagacagttggatcttgtctttttgtccagcttgccatcctatgccttttaagtgggtctttattccattcacattctgggttggcattgatatgtgaagttttgatacagaaattgtgtttttagctggttgttttgtagagttgtttgcatagctgctttatagtgtctatgggctatatgcttaattgtgtttttgtggtatcagatactgttcttttactttcatgtttagcactcccttatggactttttataaggctggtctagtggttacaaattcttagcatttgaagcttactttggtgggatatgaaattcttcattggaatttattctttttaaggctactgaaaattggtttccgatctcttctggcttgtaagtttctgctgagtagcccgctactatcctgatggggtttcctttataagtgacctgactcatctctctagctgcctttaagattttttctttaacatcggccttggtgaatctgatgtctgtgtgtcttggggatggtcatcttgtataaaactcacaagagttttctgtatttcttgaatttgcatgttgatatctctagtgagattggggtatttttcataaactgtatcttcaaatatgttttcaaagttgttttctctctcaggaatgccaatgaatcctaggtttggtctctatataatcccatatttttcagaaatttttttcatttttaaaatattcttttttccttatttttgtctaagttgaattgaaagaactaaactggtcttcaagctctgagcttcttttctcagcttagtctattctgctgtaaatgcttctgattgtactatgaagttcttgtagtgaatttttcaattttagaagttcagttcggttctttttaaaaatggctattttgtctttcagctcttggatagttctactggattcctttgattccttgaattggtttcacctttctcgtaaagccattgaacttccttgttatctagattctgaattgtctgtcatttcagtcatttcaatctggttaagatctattgctggggagcttctgcactcttttggaaagaagaggacagtgactttttgaattgttagagttcttttgctgattctttttcatctgagtgggctggtgttcctttaactgtggtataagttgagtatactcaattggcttcttttctaagtgttttcagagggccaagactctgtacaggatttttatttgtgagtagattctttccctgggtttcacagatgatgtatattggcagaatatttttggtgttgtaatttggtctgtcaaccagtagatggtgcttaagtataatggccgatagataggctttggctctgacttgtcgctcttttgtatttcagcaagtttagagcaccgctgtcttccctaggagccattcagtggcaggaactagccctcacattcggaaaccccacacaggtttcccagtttcctctctcttcaccctcagtgtctatgttgcctttgaactcttggtgtttcctctctgaagatttgttcaaagtatgtttgtttacttgatattttggtctctcttggtggcataggcacttcctggctgtgtctagtcagccatcttgtcttctgtgccctctcaaatccttcttcaagccagtatttttgttattgccattgaaatagacaataattgtcctaatgttaaggaaaaatttattcagtgatacttgttaaagtacattaaggaagactttatttagggtcattgcgatagatgtaaggaccactgacatgggattttacagtgagggagagagactcacaatacaacatgggcaagtgggaatttatagccaatgagaagggatggagagttagtagatagaaaattactaaaaggaaatatcagacttaaaaggtgattctggctaaactcacctagaaggatttttttctgaagacaggccaagataatcagacatctcctggggatggtggggaatgaagaatgcaattagatatccagggtgatcagttatcaatgtttttgctgtactgacttagcagagttttttgctaaaactgaattttacaagaaagtgcacagatgggcctaggagaaggcttggtcaagcaaataatcttcatcagttataaagcccttcacataataaaagcggctttaataattgtgaatttaaccttgcatagaaatttttcaaataagaaactaatatacttcaagaatatgcaggggattttttactagtaatttagttacatgtttccctctttttgttcgttagaagttacatgagggcagttatgacttctgttcactaaggttaattccattgaatacatacaaagcattattttcaaggccaaggccattggtagtggtggtaggggctggaacaaagaaatttattagataagatacccttaacactgatatacgtccattttgttttaagagcatttctgtagagacaaaaaagcatagaaaatatactcattgctatttggagtactttgtggtaaatctggaatccttgcttttgcttttatagtagttccataacaaggttatttttaaaacatcatccaaaactgaaatttcaacattaattggattggcacttctagttgtaaatcagcacttccagtcataaatcttgaggaaattggtatcagacctcatgatattctgttttcagtaggttagttttctcagcattattttgtgctaaggagaagaatctctgtgttttaaaccttttcaaagctatgtaacttgatatttgctcttttaaaatcttagccatcaaataccagctctactgcctgtgtccgtggctttccattctccctatcattgccctgttagggcatcattatcagttagagagacttgtattgcttccatactattcttcactgctagatgaaagtttctaaagtttagctcttatcctgtcattacaaacttgaatatgtagaataattccccattgactaatgtgttttctgtggcctaacatttctatcctttttgtgtgatttcatcccccatctacttttttagttttatattccatcgttcttttttcttcgcctaatacttaaactgttctctaaatagcccaacaccaatatgtgtatttatcattttctttacattgttttatttctctgaaatggcctttcttcagttttgcatgcctaaactctaccaaatgagcccaattgtaatgacttttccatgaaggccttcaaaccaagttatcacttgtttttctttgcttttattattttttttaacttttaaaaatgttttcttctaacttctttttaatttttttgtatttatttatttattgccctcaaacattctcctatccagttattgttcttttataaagctcatctctccttccctcccacatagttgctctgcatactttctactcctcttatttaattttttgttttggaaaatttagggactatacaaaataaacacaatgaagtttatagtatgatgtatcaccatgtacccatcactcagaaacaagttatcgttatgacattcttgtttcgtttttgcattcctccacttctcaccatccactcagtcattggtaattctttaagataaaatttacataattcaaattcacaaatctgagctggacaattacgacaattaagtaaacacatgaaacccaatccccctttcaaagtatagatagaatgtttctttctctccagaaactttctattgcctctttccagtcagtcttcccaccctcataggacggctttaacttttcttcaccttttgttttacctttcttgttctttccatgtaaatggaattacactctgtgtaagtcttcttttgctcaacatgtttctgagatttatctcttattattgcttggaacaatagtccattccattttattacttagtactattccattctgtgactgttttataatttgtatatccatttggtttatggactttttgattattttcagtttttagctattatgagtaaagctgctgtgaatatatacatgtaagcctttttgtggatattactgattcttgttattcactctagttatgttctgtaaagtcaccgtggacactgaattattgaatactgaaccattgcttctaggggaaatatagggttaggttcttgtgatcctctggtcacaacatttttgtgaactgatcaacatataattttgttttatgtgtgtttctgtttaaaggcaccttatttactatatattgttgtttcattaacattgaattcacagccaacagcactagaactgatgtctgaataaactttatctaaaatgtattttctccttaaggcacaccacagccttcttgcactcaggaatactacacagcacttcagtattcttcatggcaccattctacacaacaaaatcaccaacaaaatgcatcacaacttgaaaaacatggcaaaaaatagatcatgaaaaggacgcttgtttacagtatgattgccaaaacaagagagagtattggtatgttccacatcagctgagaatgtacctgtctgctgactcaaatttttgctgctccgtacacatctacaaattattgtgaaagagcttcaagtattgattttggggttactaacaaattttagttaggaggtgaattcacaaatgtgcaatctgtgaataatgaagattgtatatgttcttatttttcttggatagatattagtattcacaaatgtgcaatctgtgaataatgaagattgtatatgttcttatttttcttggataaatattagtataattgatgggttaaatagcatccatactttataagatactgccaagcctttttctaattgtagttgcaccattttaaattcttattattaatgcataagcattccagttgtttcatatattcatcaacatttgatattatcagtctttcattttactcattgtagcactcatttgatttttccttgctgtagttatgtgtttatgtcttatctctcccggctggaaattttttggcggcagtatataatttgtatttgtatttgccaaactaatattttggagagatactatacctttgttgttatgtgcacaaacgttggagctagaatgcctgtggtcaaagctcaactctcccacttacaaattttgaggccgtagataatgaaaataacataacagtaaaataactttttataactatattaatttgggtctctcaacaaacaattattattagtagtttggaaatcaagcctttttgaggttagatagcttgtcccagatcaaacgagtaagaggtaccagaacaagatttcaaattcaggtctaacttactccaaagccagtgctcttaactactgcacaatacagtattgccgcctaaatcccactttaaaacctaccatatgtcattaaattaatgctcatcatcctctattaagatgtaaatgatattgaattaatttaaaacttattcacttattgtaatagattatatactttttgcttttctacatgcaaaatgatgttatttgatattaatagtaattatattctttcactccaaaactttagcttttttttttttttgcctattgtgatgtctagcaccaccagttcaaatttgaatagaaatgataatagtgcatattttttgtctcgtttccaatttaaaagggaaagtttttaatatttcatgattaaacttcaagatgttttatgtattcttttttatgatttttttctttatttcttgtaaaaaaatgggatacatatgcagaacctgcagatttgttacataggtatacatgtgccatggtggtttgctgcacatattgacccatcctctaagttccttcccctaaccgctcatcacccaacaggtcctggtgtttgttattctcctctctgggtccatgtgttctcactgttcaactcccacttatgagtgagaacgtgcagtgtttggtttctgttcctgtgttagtttgctgataattatggcttccagcttcattcatgtccctgcaaaagacatgatctcattcttttttatggctgcatagtgttccatggtgtatacgtatcacattttctttatccagtctatcattggcatttgggttggttccgtgtctttgctattgtaaatagtgctgcaataaacatacctgtgcatgtgtctttatagtagaatgatttataatcctttgggtatatacccagtgatgggattgctgggtcaaatggtatttctggttctagatccttgagaaatggccatactgccttccacaatggttgaactgatttacattcccaccagcagagtaaaagcgttcctatttctccacagcctcgccagcatctattgtttcttgactttttaataattgccgttctgactggcatgagatggtatctcattgtggttttgatttgcatttctctgatggtcagtggtgttgagcttttttttttttttttgtatgtttgttggccatgtaaatgtcttcttttgagaagtgtctgttcatatcttttgcctactttttgatggggttatttttttcttgtaaatttgtttaagttccttgtagattctggatattagacctttgtccaatgtgtagattgcaaaaattttctcccattctgtaggttgcctattcattctgatgatagtttcttttgctgtgcagaagctctttagtttaattagatcccatttgtcaattttgatttttgttgcagttgcttttggcattttcatcatgaagtctttgcccatgcctgtgtcctgaatgatattgcctaggttttcttgtaggttttttttttatggttttgggttttacatttaagtctttaatccatcttgagttaatttttgtgtaaggtgtaaggaagggtccagtttcagttttctgcatatggctagcctttttcccaggaccatttattgaatagggaatcctttccccattgcttgtttttgtcaggtttgttgaagatcagatggttgtagatgtgtggtgttatttctgagatctctgttctgttccatatatgcctgttttggtaccagtaccatgctgttttgattactgtagtatagcttgaactcaagtagtatgatgcctccagctttgttctttttgctcaggattgtcttggctatatgggttcttctttgattccatatgaaatttaaagattttctaattctatgaagaatgtcaatgatagtttgatgggaataacattgaatctataaattacttcgggcagtctgtcctttcgggttttcagcattttttcattgattctttctcatctttgtgagtttgtccagtttgatctttgaggctgctgacccatggatgggtcagctgttgttgttgctttctgtttctttgtgttttgttgttgttgttgttgttgttgtttcagttgtcaggtccctcttctgtagggccactgcaatttgctgggggttcacttcaggccctatacatgtggtttgctcccgtgcctggagatgtcactcaaggaggctgcagaacagcaaagatgggtgcctgctccttcttctgggatctctgaccttgaggggcaccagcctatgccagtaggattgctcctgtatagggtgtctgacaacccctgttggagggtctcacccagttaggggcatggggaacaggaccccttttttttttagacggagtctcgctatgttgtcaccaggctggagtgcagtggtgccatcttggctcactgcaacctctgcctcccaggttcaagcaattcttctgccgcagtctcccaagtagctgggattacaagcgtgtgccaccacgcccagctaatttttgtatttttagtagagacagggtttcaccatgttggccagaatggtcttgatctcctgacctcgtgatctgcctgcctcggcctcccaaagtgctgggattacaggcgtgagccaccatctgcgcccggctgaacaggacccatttaacgaagcactttgactgtccattggtggaggggttatgctttacttgggggaagcacgttgtctgggcttcccggattcctcagaaccaccaggaggaaaggctaagtttgctggtctgcagagactgctgccacccttttctctaggggctcaggcccctaccccaaggagctgaaatggcttagacagcagacagctgtagctgtggtgctggttgcccctcctgtagggagctcagtaggcttcagcagattccagctgaaaggctattgagaatctgcagagctctggggttgggacgctagggcccagtggcatgggttcgcaagttggatcttctgatccatgggttgcgcagttctgtggaaaaaccacggtttccccagctgggtggaatgctcactcactgcctcccttggctatggggagggtgttcccctgcccctgtggctctcaggtgggctgccataccacactgttcttccttcctcttcatggaccacacaagctttctggtcagttctgatgagataacctggataccttaattgctggtgagggattcacagtcttattatgattcttttcaatgggagcctccgaacatggctgtttctactctgccatctagatagtcttaatcagattaaggaatttccctttttcctaggtcgctgagagttttttttcataaatggatattgaattttattatttttttaattattgaaattatagtttattttcttctttgaaagagaaatacatgtgtagtgaattacattgattgcattcttgaaatattaaaccttccatgtattcatttcaatcacttagctgagatatattttgtaataactggctttaatgtgctaattttgtgcttgggactttcacataagtgattatgaaagagattatcttctaattttgtttttggcttgtgttgatatcaaggttattttgggagggctaacatttttctgttttctggaagagtttctaaaagcttggttttatttcttcagtatatataactggtggtatttttattcttttcaatcttacatttttttcttgtgttattgtagtggctaggatctctagtacaatattgaatagaagtggtttgagtgaatatccttggttagttgagaattattaggatgatagccttcagtactgtaatgtcataagcattttaagtgctaggtgttatttattggctacttttattcataaaagttccacatgttgtccaggctggtctcgaactcctgacctcaggtgatccacctgtgtctacctcccaaagtgctaggattactggtgtgagctactgcgcccggccgagtttattttttaatcatacatttgtgttgaatttttaaatcaaatttatctattgaaaaggttatatagttttatccatcagtctgtgtagagatggtaaaatgttaatccaatattgcatttgagggatagtatcctttctgtatattgctgtattcattttctgtttttaaaaggatttttgcatctctactcatggaaaatactggtcagggtctatacttctgttttcatttaatgtccttggtcatttggtttcaggattagctcacttcataaagtaagttgagaatttaaatagttgacagagtttaccagtcatattatctgtggctagaatcctgggttggagtgtgttatttatgtttctgttggtggtgggagggtagacatgacatgcaataaacggcacattttaaatttatggttttatgtattattcattgtgaaattgtaactacatggaagatggtgaacctatccatcacactctacaagtttcccctcaatttttttgtgattctgggtaatctttcccttttgttctcccttatctccatctatcaccaaactgtattttctttttcccataatgatcagtttgcattttctagagctttatgtaaatagatagttacaagagaaagtcatttttttctggcttccttcactcagcgtaagtatttggaggtttttcatataaagtttattcttttttgttgttcattcatattccattatatgaatatattcacttgatcatagacatttggttgtttctagcttttggctattacaaataaaatgtacatgtgtaagtctttgtatagacatttacttttttattcatttcagtaaatacctgtgaatgaaatggctagatcattgggtagctgtatgtttaactttttaagaaactgctaaattgtttcccaaagtggttgttctcattaacagtgtaggaaggttcagttttttcagatccttacccacatttgttatgtttggtcttttaaattttaaccactgtaaaaggtatctagttgtatcttattataattttaatttgcattttcctgttgactagtaatgttgaagatattctcaggtttttttttttttaccatatgtatatcttttttttggtgaactgtctattcaaacgttttatccttttatgaaattgagttttttccttattgttgagatttgagagttctttatatattcagaatgcaagtaagacatatgcttgtaaatatttacacacagtctttgacatcttttcattctcatagcagtgtctttcacatctatcttgagacttattcctaagcatttttatattttacatgttattttaattggcattttaaaatgtttcatttaattttattttccatttgttcattggtagtatgtagaaatacaattgatttttgtatattgacctggtattctgcaactatgctaaacatacttatagttctagcagcttttgtgtagttttggggagcaaatagggtcctgatagagagatggctttatggaagaagtacaaggacccttacgggccaggttaggagatgtaaggagattcctcaggatttgatcgccagtgtttttgtctaagtgttggatatatggagtgggtgtggagggaattaccccactgccctacctgttaatgaatgtttagaggttaggcagagggttcaggcaagctgcctaaatggttctcggttgttgttcacacttacccatgtgatagaaaaagtgaaggttatcctgacagtgtggtaataagtcctgtgcctctactcaaaaggcagtattgctatggctgcataaaggatccctgaggctgaagtaacatatgtcagcaatgaggatacaggcctttaggtaaactaatgtattagtccattttcaaactgctgataaagacatacctgagactgggcaatttacaaaagaaagagatttaatggacttacagtttgatatggctggagaggcctcacaatgatggcagaaggcaaggaggagcaagtcacatggatcatggcaggcaaagagtgaacctgtgtagaaaaactcccatttttaaaaccatcagacctcatgagaactcattcattatcatgagaacagcacgggaaataccttcctccccaataattctgtcacctcccaccaggttcttcccatgacacgtgggaattgtaggagttacaattcaagatgagatttggcagaggggacacagccaaaccatatcagtctatctctgaccgctctcaaatctcatatcctcacatttcaaaaccagtcatgccttcccaacagtcccccaaagttttaactcatttcagctttaactcaaaagtccacagtccaaagtctcacctgagacaaggcaagtcccttctgcctataagcctgtaaaatcagaagcaacttagttacttcctagatacaatggaggtacaggcattgggtaaatacaaccattccaaatgggagaaattggccaaaacaaaggggctacaggccccatgccagtcccaaatccagcagggctatcaaatctttttttttgagagagagagtctaactctgtcgcccaggctggagtgcactggcgtgatcttggctcactgcaagctctgcctcccgggttcacgccattctcctgcctcagcctcctgagcagctgggactacaagcatccaccaccaagcccagccaatttttttttttttttttgtatttttagtagagatggggtttcactgtgttagccagggtggtctcgatttcctgacctcatgatccgcctgcctcggcctcccaaagtgctgggattacaggcatgagccactgcacccagccaatttttttttttcgtatttgtagtagagatgggatttcaccatgttagccaggatggtctctatctcctgacctcgtgatccacctgcctcggcctcccaaagtgctgggattacagatgtgagccacagtgcctggccagggctgtcaaatcttttttttttttttgagacagagtctccctctgtcgcccaggctagagtgcaatggcacgatctcagctcactgccagctccaccccctgggttcacaccattctcctgcctcagtctcctgagtagctgggactacaggcacccgccaccatgcccagctaattttttgtattttagtagagacggggtttcaccatgttagccaggatggtctcgatctcctgaccttgtgatccaccgcctcggcctcccaaaatgctgggattacaggcgtgagccaccgcacccagccggctgtgaaatcttaaagctccaaaatgatctcctttgactccatatctcatgtccgggtcatgctgatgcaagaggtgggttctcatggtctgggcagctccacccctgtgtctctgcaggatacagcctccatcccagctgctttcattggctagtagtgactgtctgtggcttttccaggcacacagtgctgtcggtggatctgccattatggggtctggaggatggtggccctttctcacagttccactaggttggagccccagtaggaactccatgtgggtgattcaaccccacatttcttttctgcactgccctagcagaggttcttcatgagcgccccacccctgcagcaaacttctgcctggacatccaggtatttacgtacatcctgtgaaatccaggtggaggctcccaaacctcagttcttgacttctatgcacttgcaggctcaacaccacatgaaagctgccaaggcctggggcttgaaccctctgaacgcatggcctgagcttatactggcccctttcagtcatggctggagcagctgggatgcagggcaccacctttctggactgcacacaccatggggacccttggcccggcccacaaaaccatgttttcctcctaggcctttgagcctgtgatgggaggggctgccatgaagacctgtgacatgtcctggagacattttccccattgtctaggggattaacattcagctcctcattacttttgcaaatttctgcatccggcttgaatttctcctcagaaaatgggattttcttttctttcgcattgtcaggctacaagttttccaaacttttatgctctgtttcccttttaaaactgaatgcctttaacagcacccaagtcatgtcttgaatgctttactgcttagaaatttcttccatcagataccctaaatcatctctctcaagttcaaagttccacagatctctggggcaggggcaaaaagctgccagtctctttgccaaaacatagcaagagtcacctttgctccagtttccaacaagttcctcatctccttgtgagaccacctcagcctgtacctttttgttcatatcactatcagcatttttgtcaaagccattcaacaaatctctaggaagttccaaactttcccagattttcctgtcttcttctgagccctccaaactgtcccaatctctgcctgttatccagttccaaactcgcttccacattttcatgtatgttttcagcagcaccccattctactggtaccaatttactgtattaatccattttcatgctgctgataaagacatacctgagactgggcaatttataaaagaaagaggtttaatggacttacagttcttcatgactggggaggcctcacaatcatggcagaaggcaaagaggagcttgtatggcagtggacaaagtcacctcttatatggcagtggacaaagagagaacttgtgcagggaaactcccatttttaaaacaatcagatttcatgagactcattcactataatgaggacagcacacgaaagacccacccccataattcaatcacctccgaccaggttcctcccaagacatgtgggaattgtaggagttacaattgaggatgagatttgggtggggacacagccaaaccatatcagccagcaaccttggaagttagtttgcttgatcatgtgactggctgctcaaagctgaaagcaaatacaaagcctactaaaaatacaaaaattggctgggtgtggtgatgtgcacctgtagtcccagttacttgggatgctgaggcacgagaatcacttgaacccaggagatggaggttgcaataagctgagattgtgccactgtgctccagcctgtgtgttggagtgagactctgtttcaaaaaaaaaaaaaaaaaaaaagcaaagtcatgcttattggtgtatgtgccactttctcagtttgtgtcctctcatcctgccatcccccctttaccctgacatcagctgcctcaaggagaaaactaagtgccctggagaaattttaaagaagaggagggacctgaactttcatggctttattggatacgggttaccagatcaccatccttggtcccatgtgggaagggaaagctgaacccagggcttgccaaaagggctgaagatgaaggggaagagctaccgtaatatttcacctccttgagcgaggttgctttccaaatatcagaagctacatgagggaggaaacaactgcagggtttggacaccaaccctggagcgagcagccaaaggagagaaaaagtctacacagtgctcctcatgtccttatcgtccttttccactcccagtactctctgctccccagattttcagcctggagatattacaggcattttgtggccattgtaagctgtcacataccaacactctgtagattgtcaaatttatgaatgtaccatttcataatttctggaaacatgttttctcttagtacagttcattaatatggcataagacatgtttactggcagactcaaatatctttatttcctctgtaataagaagaactaaattactatagcccttgacatgtgcctgtgagacaccttggtccgtgttttagtataggatctgtatctgaattcaactgctagatttgaggaaagtttaccaagggatatgatgttaaattgaccttgtgggtaaagcccttgggctgatttcatgtacaaagtttactctattaaataaacggttgggtctggttctctgatagcttaagtgaaaagctaatggtgtccactgggtggcagccaccctccagctccaaggacagtctaaaagattaactggtaagggctgatccagcacaatgggctgaattaaaagccattttcttggaccaggggttgagagacttcagtctgtgtgccaaatttggctacaatctgtttttctattgctcttagcttgggaggatttttacattttttaaagcattgggggaaaaagaatacacacttgagactgtatggggcttgcaaagccaaaactatttactatctgctcttttcagaaaacaagttttctaactcctaccttagacagtattcctaaggattaagttatgatatctttttcctgagtgttgggctcttgccagttacttcacttgggtagtaatagtagattacagagacacccctccatggagacataagctatgaactgccatttggaagggctgggtcactcatgttgatgcctagagtaagtgcctgtttttacaattagtctgaatggaatcaagctgctggtcaagcctgcacttgttagtgcctttcaatctggaaacttgtctttttttttcttcttcttctttttgaggcagggtcttgccctgtcaccaggttgcagtgccgtggtacgagatggtcactatagccttgacctcccagtctcaagcaatcctctctccttagcctcccatgtaactggaactacaaacacgcaccaccacacctaattttataatttttttgtagagacagggtctcactatgttgccaagggtctcgaactcctgggctcaagtgatcctcctgccttggtctcccagagtgctaggattacactcatgggccaccatgcccggccattgtctttcatttttggaaaattttcatatattatttacttgatcagcccctcccttcttttttcttgttttgtttttctggaatttctgtttggatgttagagtttctcaatttcccccccaattttcttaacttttctttcctattgtctgccttttgtcctacttcttggtagtttcttttccctacctttgttttcaaaccttctaatacagtttatgtttcatttacatttttaaattccaagaattcttcctccaatgcctgtttgtaataataccctgttcttatgtcaagtacacaatttgtcagtctccatctaataaaatcacagtgtggttttttaaagactattctgtttcttgcattgtttattcccaaatcctttttgtttgttactgcgtttagtttaatctgtgctatttatgatgcaagctttcttcacatatcttgtgattcttatatgcagatttatatttaatagggaggcaataaatatgagttggcttttctatgtaataggacaggccttataacccagtggacttcattgtagggttattaggtaggtatccagaggtactcataaatgtcactatcatagggcattttctcttgggctgtttagttccttctgagaaaaacttttaacttcctacctgaatggtgtaaacttgtctggcagtgttattttagccatgtgatggagaagtctgggattctcaccatttagtatgttaactttcaattaatacccctgtttttcataaggtgcttctcctctaccatctattatgcttagataattatagagaaccagaatctgtttagcaagggctgaaatttatgttctatcttatagataggaaaagtaaatggagcctaaaatgcagatataagtgcataaaagttattctgttaattcttttctctatattaaatatgatgtttctccaaattttgatgttttatttgaagccataataaactttgttctaaggcattcacattcatttaagtaattggatttattttatgaaacattctcattctgatcaaaattttcaccgaaggatgaagatttaacagaagtgctaatagtaatatatttgagttgaactttaggtaacatgttagaaagaagataacttaatattttgaggatattttccatttaaataaaaacagcaagaaccaatgtattaaattgaatgctgtggttctagttattgttttttggatgtatttaataatttctaatgtctttttggcttaacactggacctcacagttaggtaatgaggatggaagtagtatatttgcctttctatgaatgccataccataagatttttcaggatatttttgtagttaagaagatagcatatgagtagaatgatagataattcaatttgaggtacttgtaactgaattggattcatgtctactggagatgagattctcatggaaaatcaacagctgataatgtaaatgaagaactttgtgatcctacaaattataaaacagtgcagttatcatttaggttttaggttttgactgccagagatttgctttatagagatttgctttattgagatttgctttattgggaatgcctatatttcagtgttagaattattataattgactatagatcttttatataaaatattctcatttgggggaatagaggatagatagcaatatatgactcttaccttaaaattggtataaatctaatgaatacccatataattactattgaacttaagaaataaaacattacagataaaatggaagtcatctgtgaatctcttacctataccattcacctttatcattctcttcccagtagtaacccttattctgaatttgttgttttatattccctgcttgtttcacaattttactctttttctcacatccagaataaatgtagtcttgttttacgtatcttaaactatatttgaatagtatcaaactggaacatgcttccccccgcccccaacattgtttctcagatacattcgttgatggatctagttctttatttcaactgttgaagagtatttcattgcatgaatgtatcataatttattattaattcctctattgcttgtttcataatttttactcttgtgaacagtgcttcaaagaatcatgaataggtgaaaatttccttgaggtatgtatctaggtatagaatggccagcatatagtatataaacttttaaacattttactaatttttttgaatcgttctttaaagtagtcccatcagtttactgtttcatgagaaatgtatgaggtttcacaaagacttgatattgttagacttaaagtactgataatctgatgtacgtagattatattacagtgaattattttgcgttttttggtattaggatatttttaaaatgaagagcaaattatttgttctctctttgtctgctttcactaataatggtgtgcttctaattacctagtctgttttcccattagttcatagttttattaaagaaatctctcttctacctactgttagatacaccaccccattatataaagttcatttggttaggtttattttgtgctaagcaactaaatagaaaatggaatgtttttattgtctttttgtgccctaaaaagagtcagtcagctcttggtaggggaaagaattaagcctgttgtctaggtgataacagtagaataatgcagtgagggagtgaaaaatcagggatctaagttgcagaaaattcagttactaacagcaattaattgaataaagaaaatgcaaagttatgaaaaacaccagtactttgattatattatccttgtagaatacagtcattcattgcttaatgatggggatgtgttctgagaaatgcattgttaggcaattttgtcatttacaaacatcatgaaatatgcttacacaaacctaggtggtatagcctactacccacctaggctgtatggcataggctattgctgtcaggctacaaactatacaggatgttactgtactgaatgaatattgtaggcagttataacacaatggcaaatatttatatatctaaacatagaaaaatgctgtaaatatgtggtataaaagataaaaagtgatataaggcacttaccatgaatggagcttgcaggactggaggttgcttcgggtaggtgagtgagtgaatggtgaaggcctaggactttaccatacaccactgtagagtttttaaacaatgtatacttaactacactaattatattaaaagatatttttctttcttcaataataaatttactttagcttactttaatttttttagtttataaacttcttgactcttttgtaataatgcttagcttaaaacataaacatattgtacaaaaatgttttatttctggcaggcatgtggctcacagctgcaatcccagtgctttgggagggtgaagcaggaagattgcttaatcccaggagtttaaaaccagcatggggaagataattacaccttatctatacaaaaaaataatttaaaaaatgagccaggtgtgttggtgtacccctatagtcccagccactctggaggctaaggaggaaagattgcttgagcacaggagtttcaggttgcagtgaactctgatctcaccactgcactccatccagcctgggagacagagtaagaccccatctcaaaaaaaaatacatatatatatatataaatatatatttatatacatatataaatatgtatataaatatatatttatatacatatataaatatgtatataaatatatatatacatatataaatatgtatataaatatatatttatatacatatataaatatgtatataaatataaaacacacgtgtgtgtttcttatcttcagtctgtaagtttcttttctattttatccttttactttgtaaacttctttgttaaaaattaagacacaaacattcattagtctaggcctacacagggtcaggatcatcagtatcactgtcttccacctccttatcttgtctcactaaataacacctgtggagctgtcatcttctatgttaacaacacctttttctgaaatactgcctgaaggaactgcctgaggctgttttagtgtcaacttttttttaataagtaggggtacaccctaaaataatgatgtaaagcatagtatagtaaatgcaaaaaccagtaacataatcatttattatcattatcaagtgttatgtagtgtacataattgtgctatagtttttttatatgattgccactgcagtaggtttgtttatcccagcatcaccacagtcatgtaggaatgccttttactgctactttatgatggctatgacatcactatttgataggaatttttcagctccattataatgttatggactcaccatcatatatgcagtttattattgactgaaatatcattatgcagtgcatgacttcaattatactctatttaatctcccttctaggtcctgatttttaaggtaatttgaaatcattttttctgcctttctctgttactatctgaattgcttcctaagaagattaaataagagtaaggactttttcctggatgttaaccgtaacattagcatgttattttaattaaattggtttattaaatataatgacatagttaaatattgatgggggaagggagtagtctgtattacatccagaggagggatggttctactggaacttactggacagctagatgacaatatgaagatctaaggaatggggaagagaagaaagggataagataagagatgctgaaaggtattcttaatagacttaagtattttacttgggttatgctcttttctataattttcactggctcattagaagtagaaaagtttataagtagagaatttaatagaagaaaggcaggtaatgttgttgagatgtgtggggtcagatctatcctgaaataaaaagaatctgatcacatttccttagtgatttaaaatagaaaaacagggtgatagaaataaatgtcagaagcagaaattggaagaaataaagaatggcaagtttaatgttggcaattggtcatcagaatcctattgttgttgttgttattttttttttaagatggagtcgcccaggctgtggtgcagtggcgcgatctcagctcactggaagctccacctccctggttcatgccattctcctgcatcagtctcctgagtagctgggactacaggtgcccatcaccacacctggctaattttttgtattttttagtggaaacggagtttcactgtgttagccaggatggtctcgatctcctgacctcgtgatccgcctgcctcggcctcccaaagtgctgagattacaggcgtgagccactgcgcccagccatcagaatcctattttaacttatatttgtagattttcttgtcatgccagttaattacatagtctgtttctggtatttcctatgttgacttgatcatagctgtcactaacaaatacttttatcttcgacctatttaatgtgttttttttttcttacattttatggagtgtttacatgatcccctcttacttaactttagtggactgtcaggattattgtcccatgcccattttgcctgtagtttttctttaattgcagtcgttctttttttttgtttttgtttttgtttgttttttttgagacggagtcttgctctgtcgcccaggctggagtgcagtggtgctgtcggctcactgtaacctccacctcttgggttcaagcgagtcttcgtcctcagcctcctgagtagctgggataacaggcactcaccaccatgcctggctaatttttgtattttcaatagagacgaggtttcaccatgttggtcgggctggtcttgaactcctgacctcatgatccacccacctcggcctcccaaagtgctgggattacaggcatgagccactgcgcccggccggcacagtcgtcctttttaacagtgtttattttagctcaaaacaaatgtatttattattcttgagtttcctttattattgctgaataacttcaagtaatttttgttttttcctcactaggtctttctttgcaaatattacttttagataagtttgtatgagtcttaaaaagctctttctatgtataattaaaacaagatagcacctttattttgactatgtaaataattgtatctcatagattcaaagctagcttgtgtttgcagaagacagtattgccatagtgaagtaattttaaagtaaaatttgacaacaactagactaggtctgtaggaggattttttattgtattaaggctcatactgtgctaagtataatattttttattttttgatgaattatattagaaactaatttttatttgtagttctactttatatattttctatattagagaaatttcccactaaagaatcttcattaacatttttctgcaagtgatttccgaatgtttctaaccctaaacagtttcctatcattgcttctaaacatttttttctttttaaatcttgctattgcttcgaattcaggttgtttgaactctttattatccttctcttctgctaccttgttcccaatccaactaccctacctaatttcctattcgtatcattggtattattatttttctggtcaataaaataaatgtttgttgaaatttacattttaatcctgctagctctgagatctttgggaaataatgtcttcaagtttcattatcttgtctataaagaggggagagcaatgtttcatgacatgagattggcaaaatgattagattaaatgagatagtgtaagtgatgcacttggtacagtgcctgtctcttagcaaatgatagttcccctgtaggtatatgggatcaaaagctcatagttgtttttgacacctttcttctctaaaccctctgtattgcattttccatcaaattttgataatcccagctttataatgttcacatatatttgattttattgtattctcttagctgaaatattgatccaggcgcagatttgctgtacattaatgtaaaggttgacttccttacagatttgtctccatactttcctttcttacaatacattcttttttttttttttttttttttgggatggagttttgccctgtcacccaggcagagtgcagtggtgtgctctcggctcactgcaacctcctcctcccaggttcaagtgattcttctgcctcagcctcctgagtagctgggactgcaggtctgcgccaccacaccctgctaatttttgtatttttagtagagacggggtttcaccttgttggccaggctggtctccaacttctgacctcgtgatccgcctgcctgggcctaccaaagtgctggaattacaggtgtgagccaccgcacccggccccttataatacattctgcgtattccagtcagatgactttttctaacattccacgtttgttatgccatgtatctgctaagaaagaacaacaacaaaaaaggaattgttccttattgtcttacttcacttagtggaaccatccattccatccagtttggtctgcttactcaaagactattaccattcttctttctgtgcccttgctcaggccaggccttcttcacaacgtcattcgaagtgtacaatgtttcttgcacttatttccaatttaattgtgtactgccttgtgtagttcttatattactgtcttctgtcaatattaaatttaatcatatactgtcacatcatagttttgttttattttctactgtaatttaactttctgattaggccattttcttttctaaggtataaattctcctatacttcttatcttctttgaattcattctgttattctatgtatgtacttcaatttcttataagaaaaacagcacaatttgagtttgaaatttacttttaaaattataattaatgaacatagtactttattaaggaatcaacaaaaagtgttttattcaactggcaggcaaacttttctatttccataaattagttttaccaaacttcaaccttatataaatggaattttgcattttactgtatactctttctgtttggcttcattttagttttttgagatttatctatattgtgctgtataaaataagtactgcattcttttttattgctgaatagtattccagtgtatgaggattttacaattttatacattctcagtttaagggacagctagatttttaatgattttttgctgttattaatagggttgcagtgaatatgcctgtacatatatttttgggtacgtatgttttcatttcttttgaataaatacttaagtgtgacttgctggattgtatggtaagttaaacgtctttgtccagactgtcacaaaggtggtgctgtactcttcccattgtatcccatcagattgcttattattttgggtttctctcattactaatgatgtttaaagatttaaatgtatgacttgagactgtcaaactactaaaagaaaacattgcaggatgctttaagacattggtttgggaaaagatttagtttctgggttttctttctgttttttttttttttaataatatctatctctgtttaatttctcattcaggtcatgaattgttttcctggttttaaaattatttatatgtgttcttttgtatcttgtagagtttccttaggatcattattataaactcattttcaggcatttgacatattttcttttctttggggtctgttactggagaattattgtgttgttttggaggtgtcatgtttccctgccttttcatatttcttgttcccttacattgatatttgcacatctggtgtaactgtcacttctaattttatggagtagcttctgtaaggaaagactttttcctgtagatgtagctgtaatgtttgttgggtagaatgttttcgcattggttctcggtgattgcaatggtgtagtttttgtatgatacttcacctgtaatcaacaactgcagtgtctgtgattcccttaatggcttagcctgcagttgtttgtggagattgtggtgagactttggtggggaaggggtcatcagccagactgatcctcaggcctctaggtgtcacgtgggggcaccaacagtggtggttgtgtgtcctgggtgagccaatcttaaggtcctaggtggggagccagtggtagcagtgtcaggcccttcctgattggccctcgcatccctgggccgggctacacagattctggtagtggcactggtgggttggtcttcaggtgcccaggcatcagtgtgtgttggtgactggccagtctggctggtccccaggctcctgggtgaggcgcacaggaaccagctataagattgctttttttaaaattaaatattaagagcctttcttaagctgtgtggtgtggctttcttcactcctgctgctgatttaccaccattgtttattagattgggacaagatcactaactactattagacatgtaccccatttttactgtatattgctgtataacaatggtggcttaaaatagcaaaagtttattatctctttcagttatgtaggtggactggatgtaggttgatagatttgtttccatctctgatgtggtgtctgctggatagctggggcatctaaaatagccttactcacatggttagcagttggtgcttgttgccagctagaactcagctggagctgttgacaatgttcacatgttctcttgaacatggactttgtatgattgtttgggctgtctcactgcatgggacctagattctaaacagaagtgttataggtgaccaattggtagctgcagttttcttaagacaaatccttagatgttacactgccacattccattggtcaaaagaggtcatagagccaattcagatttaacagataggggaaagtcatgctgaaaaagaacacgtgggatgagataatgttgtggcccttttaagaaatataatttacttaatttgaaatttcctgtgaaattttgaaacttactttgaaactttgaaagattattagcaattttccaaatagtttaacttcattattaagtgtattcaaacttcacagaagccagtatacaaagggaaatcccagatttaagtgatgagtttatataccattgtttaactggtcctctgagtgatcctgcatgattgataatccacactactgtctctctagacagaagacagactcagtaaggaaatgttttaagtgggtgtaattctgatatctgccattacaaaaacaacgacgaaaaagcaaatatttcttcttatttcttatcagcaaaagaaaggaatgaggtgtactggaattcctagcactgtgatactcaaaatgtcagtttttaaggcttttgtgttttagggaaacactcaaagaaaaaatttatgtgagttttcaggctgtttacttacattcttaagaaaaagtgattttaggccgggcacggtggctcacacctgtaatcccagcactttgggaggctgaggcaggcagatcataaggtcaggagatcgagaccatcctggctaacacggtgaaactccgtctctactaaagaaaaaaaaagaaaaagaaaaagtgattttagatcttttcaaagatttgtttaatgtgtatttgttcatattttaatttttaaatgtaatttctcactggtaaattttccttaaaatataaattgctccctggatatttgttcattattttgcaaagtacaaaactccattagagtttcatttaataaatattaagtacaatattgggaccccttattggcttatataaatcatataaacaggtgactgtttataggattcctttattttagctgccagtaagaagcctgccatgatttttttatgtctttggattccccatcttacctgccagctctagtatctattattggtagccataaaaaatactgacaatatagaccagtttgaattttcttaaatttatcacataggtataccatatcacctaaaaaagttaatgtgattacaaagatagctaatttatactcagtcagcagattcctttatttggctgtgtctccaagataaattaaaaataaaataataaaaataaaaaactatagttgagttataatattttactgactgaaatttaacttcagccaagctttaaaaaaattacacagtttatatcagtacatctttattttatgttctatacatgactccatgataagtgttcaatgtggatttcagaggatcccaaatgacacacacacatacacaatattgtattaaaaagtcagattggtaaggaccctgtagaaatcaggatgcttgcaacatggatttcagcaaagtttctgaaaagataattaacaagcaggctggtttatagaatatataataaggctctaaaaacacaattgggttttaacatggcaagttgatgtagcccaaacagtaaataatctggataatctattatcttgatttttaactgttttgattcagatatttctttgtaatgaaatttttggcaaattaaaatttcacaacgctactcttagaacaggatataggaatctcctcagttaacacccggactcctttgtcagatctaactgtagttgtaagtatttgccttgcttactttgatgctgcagtccttggtatgtatgatttccaaagaattgaagagtaagtttaataatcttgtcactttatttagcttggctcttcaattcattggttattgatattaagattttggtctttagaatatagggtgtgatttgacttatagttaataggttatacatggccatacttaaatctctaatgatatgcctttgcacttaggataaaatacaaaatctttgcagttatgtaacccggatttttaaatttcaagttagttatctttacaaatttttatatctttccaccttataataaacatgaaacattaatagattcagggaatgaaatccttttcttaagaagataagattaaaattttatgtcatcagaaaatataattttagggtactaaccagtaagatatagataaggaatgagacaacctatagataagctttacctgctttattaagtctaatgcatactagagacttttttattctttgagtttcaggaagttaaatttgttcctctgtctcataagatagtattatagtttgtgagaaagttctaatttaacaaacacttaaaaggactaccatgtttaaggcattttcttaagttccagaaatatagtctagctgaaaaatcaaaatcatgtgtattatatattatgaatatgtataatacagtgtaatgggtagaataatgggagcatgtttaaatacagtggggaaactggtaagtatgaggttaattttgtttgttgctctctgacaaaaatcttagaaagtcagtggcctttaaccctcagtacaacaccaaggtccattggattctgttttacttttgagtttctgtttttgagcaattctgagaatttataaggattgatattttatgacttttattattttctagggctcttccaaagagcaaagagaaaaagtgtttatttctgtacatatatatatatttaaattttatatttaccacctggatctattgggcctttttataaatctgtgatatatttttgtatcatagtgttcttgtatttcctccatcttgaaacattttgctgttctattattattagaattatttcatcattacttatcagctagctttcttcaactgcccttaaatagggggctgaggtgggtgaatcacttgagatcgggagttcgagaccagcctggccaacatagtggaaccctatctctactaaaaatacaaaaattagctgggcatggtggcacatgcctgtaatcttagctactcaggaggctgaggcagaagaattgcttgaaccagggaggcagatgttgcagtgagctgagatggcaccattgcaatccagcctgggggataagagggaaacactatctcaaaacaacaagaacaacaacgacaacaacaacaacaaacaaacaatgaaataaaaggaaaatgggagaatgatgaagtcatctagaagagtagtgcagtagttgaataaatggtcactattgctttatcctttagttttatcaagttgtccaaaatattgcatgatctttcatgaatatataaataaaagaagatcagagaccccatctttgtagtctccttttccagttgagaattcagaatttttaatttttttttcaaactttttttttgcttgggggtaaattttccctttaattcttcttttccataatgaaaaagttatgaaaattgagaagagactttaatatttactagtcaaatcagatatcagggctctaatgttaatggcaaaattggtcttagaagcagatcctcatactgagtcatcagatgacacattccaagatgcatttcttcagacaactatcaatgtgtgaataatgcatttctcaaaacaaaaagcagataacgtattcacattcagttagtgaagaacaggaaggaccttatcacacagtattttgcagcaagaacctggaccatctcattttgctaaaaggataggtaacatattctttaatcttttatgatttcgtgctcagattcattatatatggttcctaagtggacaaatactgaaggtaaatatatatatatatatgcataggtgactagaaggaaacagataatgtagaaatgaaaaaattattaattggtaattataagtggtgttataagtgtaaaaatgaaacttttgcaattatcgaacaaagaagatggccattttctcttcatcaaaactataagctaaaggtttaaaaaaaattcatcaggtgtgctgtattttgatgatgtcagttcaagaagaacaagaataatgataagttagatccaattagagatgtatttgacatctggaatcaatatgtacaagatggatgtgtctctggttcatacatgacaattgatgaagcgttagttgcatttagaagacattgaatacatatacattcaaaaccaaaactttctgatgaaatttcactgctcctttatttttacttctgcaatataaaatgacttgaacataaaaataaaattacatagtccatctgacccagctggtgaatggtgatgattatttttttttttggcatttgaaaagttaagctagaccttgaagcttattttaaagtttggcaaataaaaggcagaggcaagagaatagctagaaatatgtatgtgtgtacccccacatacacatatatatgtgtatatatgtaacatataaactatagatgatattttataaaatttatatatctaaattgatttataagtttatacatctacaaattttaacagatatatacatatgaaattttgtctgaaattaaagcttgccattgggagattttatatgtaaatgtaagtagtgcttatcgtatttctgtttagaaagtaactgggtattcattggagattaggttagagaagatattaaatgtagggatttaatgaaggatcacagatgacatagactggagttaaggcatttataataaagaagctgaaacacctaggtgcaatggatcatattcttttgttcattcctgaattgatttgtgtgtgagataattttttgtggcctaagaaatggttttgggctgagcatggtggctcatgcctgtaatcccagcactttgggaggctgagacacgcggatcacttgaggtcgtgagttcaagaccagcctggccaacatggtgaaactccattcctactaaaaatacaaaaaattggctgggcgtggtggcacgtgcctgtaatcccagctgttcaggaggctgaggcaggagcatcacttgaaccttggaggcaaaggttgcagtgagccaagactgcaccattgcactccagcccaggcagcagaatgagactctgcctcaacaaaacaacaacaaaaaaatgaaatggttttggaagacatttacaatagtttatttcctaggtcacattaaaaatgaacatgaaatgatattaattacttaacagtttttttatcctttggggttttttaactataccactctcttattgttatactatgaaatgtccaaagtgctactagtacttttgtttgaggcaaatattattcagagactaagtttgaccttgaacatcaccttggatttaatacaggctttcaagtaaatatttgattttaggaaaacctatgtgttgaggctttccttccaagtagaatggagtagctggtagcaaattagtacttctgcttagagcaatgagaaaatcaagataaaatatacatgtaaccattctgtatcagagttgaccttggggatgtatttcaagtctcagttgtatctgtagtaaagcttattcttcctctgttttgtcctaattatattggtaatcacattcaatataaattgactaattattaaaattgaatcactaagcttgtcaggctgtataaaacaagtaaaccccaattatatgctgcattcaagagccacatcttaaattaaatgggaggatgaagctaaaaggatgaatagatacactgtcctaacactgaaaggcaaactggtgtagctactatatccaataaggtagactataagataaagactaaatataggtggtccataacgtatgatggttcaacttacaattgtttgacgtaacggtggtgcaaaaatgatacacattcagtagaagctatgctttgaattttgatctttctctaggctagtgatatgtaatagaatactctattgcagtgttgggcagtagcagcaagctgcagtttccactcagccaagcagtcatgagggtaaataaccaacactctatagtatatgaaatgtatttttgacttaacaatatttttcacttacagtgggtttctcaggatatagcctcattataaagttaggagaatttgtataaaagatggatgttttataataataaaagggtaattgtatcaggaagttttcactatcctaaatctgcatgcacatagtgagatagtatatataaagcaaaaattgatagaagcaaaagaactggacaaatccccaaatatactgggagaatttatgatgctgtcagtagtaccaaccatcaatagctgatagaacaagtagatgacaaaaaaaaaaaaagagagaggtagagcacatttttacagcaagagtaataagtgacttaatttacaactatataacatttcactggaaaatatgagagtacacattcttttgaagttcagatggaagattaatcaaaattggccaaataggggatatagatcaataggtataaagatttagtgcaattaaaatgtcaaataggttttgggttttttaaagtaaaaaaatgactatctcttctgaaatttgtttagaaattcaaaggatcaaggataatcaaggcaatcttaaggagtaacaaaataagtgtaagagagagtaccaattgtcatcattttctgtaacacaatactagagttattaaaaacagtggtattgatgcaagaataggctggtgcaagaataggctagtgtaacaggagagagtatccagtgtggtaggcagaataatggccttcaaagatatccagccctaattcgtggtacctgtgaatatgtcacattataaggcaaaaggaactttgcaaatacagttaaggttacagacaattaagatagtaaaatgatcctgggttttctgagtgggcccagtctaatcacatgaacccttaagagcagagaagtttttccagctgaaagcagaatagagatgcagcagaagggggagtcattgattccaagcatgagaaagattctgtgcactattattgatgagatttaagggcctatgtaaaagactggagagaggcctctggttgctaaacatagcctctagcttaagtcagcaaggaaatagggacatcaatcctgtaaccaaaggaactgaaggaactggactgtgtgaagtagaatctttactgagccttaagagtacgagctcagcaggcagacattttgatttttgttttttttttttttgaaactgggagtagaaaaattagctgagctaacctggatttctgacttgtaaattgtgaatagtaaaattgtgttgttttgagctgcaaagtttgttctaatttgttacagaagtaaaagaaaactattacttccaggaacaggtctgcatatatgcttctacctgatttatgactgatttttttaagtataatggagaaaagaattttatttcaattcaatatccttatagaaaatatgcttattgacatacataaaaatccattttaggtacatcatagatccaactatgaaagatttaaaaaataaagcttttagatggaaacatggcagaatatcttcgtgatcttgggttagggaaagatttcttaataataggaaaaattgatacattggatcacattaaaaataagaactttagaaatctaaaaactgaaaggtaaatcatagaatgaaagaagatacttgtaatacatatatccaacaaaggactcatattccataacccaattttaaaaatgaataaaagacttgaaaaggcacttcacaaatagtatatgttcaatatgaacatgaaaagatactcaacataaaaaatcattagggaaatgcaagctaaaaccacagcaaaatatttctacacacccaccagagtggctaagtaaaaaagatgccttttccaagtgtttgtaaggaagttgtatagttggatatctgatacacaaattggtactaccactttgggaaactgggagtgtttactaaacctgaacatatatgttatctattacccaggaattttagttgtaggtatatatctaaaaggaaagtttgcttaagtttaccaaaggacatgtgcaggaatgttgatactatttgtaatgacctaaattggaaacaatccaaatgtctacttatagtagaatggataactaaatcatggtacattcatagcatggtatactgtacaatgagaatgaacagcatacaattaaatttaaacatagatgaatctcataaacttaatgttctgcagaggcatcagatacaaaaggaatgcctatggtatgattcatttttataaagttcagaaacagacaaaattaatatatagtgttagaagtcagtatttccttctgttgtgggtagagcaatgactgggagaaagtatgaggggagttttttttttttttaatcaaagatttagacactgctttcaagctctatatgtgtttgaggaattggtgttttcactctttttattctttttcttatgtagataataactatagttaattcactgttttacttcgatcagtttaataatactgattatgttcacgtttatttgagtcttgtacctgtaccaaccaggtagataggagaagtatatgcataatcaaagacagccaactgagccagctgagatttatttacaagtgatagcttaattatttgggggctttacattagttctttcaattaatcagttttttgctttcttgtctattcattggagtttacttctaaagctacctgtcctttgttgacatttggatttctctgtttaattatttagatttgggattagttctgtaaaattcacagaacgccttgggttacacttgagtttgggaacaagtaattacaagttatattaagattgtaaatgatctgtatactgcagacatcattcttctcaaatttctctttaagtatgtctaaattataacataaaccagtggtttagtatgcttttttagatactgatgatgctttgtgagactaattttattctctacccacatcagtatcttttctgattgccttgatgaaattagataaacctttatctatgccacccactaccaaagatgtttcacttttccttctatccttttaagggtatttatcacaatgtcaaagcaggaaaaatagtaataaacatagttatagaaataataacagcaaatggttataacatgtcaatcagtatttaaagcactttattgacttatttaacatatgaaacaactgagagaggtgtgattgttagcttaattttaaacatgagaaagaaagtctcagaccacaggttaactaacttgctgaaggtcacacatctattaaatgtatgtgtcagaattaaatccagattacctagtctttgtccttaaccactgtgccagtaaaagacagataaggagattttcaaagttaaaattcagtcactaactaaacaaatctgggattataagtttttcaaagttttgaataagctaatgattatatttaaatagtaataatttttaggtaaatttttttataattgcatatttaaaatactaatttaaattttgtagtaaggcatgtaaatgttgtttgccatactgtttcatgtttggaagtctgtttatgtttatcctttctttcccaatatataggaaaaggtaattcatgggccatcctaaaggagtgtgttaggttgttctgtagctttttgtagtagtatatttgtatgtaatgaagtgcatttttaaattgcacttgtaatttttaattgcttcttagaaattcctgaatatttaggaacttcataaaaatattctggaagcaagcattacctggataacatggtacttaaaaacctttcattatcaaggaaataaaaaatagaaaagaatgttggtatgaattataagaatggaaataatctaacagatatttatctaattacatttatccagatgagtttttctgatttgcttataatacatcacaacaacatctcagcctgtctccaggttggtacatctttatttaaaaatttgggccaggtgctgtggctcacgtgtgtaatcccagcgctttgggaggctgaggcagatgtattacctgaggtaaggagttcaagaccagcctggccaacaaggcgaaatccctcctcagtatactaaaaatacaaaaagttagccagccgtggtggtgggcacttgcaatcccagctacttgagaggctgaggcacaagaattgcttgaatctgggaggcggaggttgcagtgagccaagatcatgccattatactccagcttgggcgacagagtgagactccatttcaaaaaaaaaaaaaaagaaaattttttttaaagttatttaaactgattttatatgcaccatttatttataacaattttattttattttataatgttttacatttgtgtctctcattagatactcagactaaccctatgatctcataggggagatataattgtcccattgtttttacaaggggcctgatgaccagaggttaaaatgtatgtacagagtcactctacaaatatgccatataattatcatttgaaaccacatcttccgttctctgatacaatgcttttcccattgctccaggtcacttctcatatgatttgaaaaccaaccaaccaataacaactttacctatgattagaatcccatcatttaaagagtgacaatttagttacaaaagattaaaaagaattcaacagcaacaaaaaaaaactagattaaaattgggcaaggacttgaatacacatttgtattatacaaagaagatactcaatggccaacaagtatttgaaaagatgctcaacatctctaatcattaggcaaatgcaaatcaaaaccacagtgagatattacctcacacacctaagaatggctgctgtaaaaaaagaaaacaaaaccagaagaatcctgaaataacaaatgttggtgaggatatatagaaattggaacctttgtgtattgttggtggggatgtaaaatggtacatccattatgaaaaacagtataatggttcctcaaaaagttaaaaatagaattatgattgtacaattccaagaattgaaggtagggtctcaaagagatactgatatgcccatgttcatagcagcattatgcagaacagccaaaaggtggaaggaatgaatagataaaacaatatatatataaaatagataaaacaatatatatcttgagggcgttattctaaatgaaataagccagcaagaagaagacaaatattgtataattccacttacatgagatatttattgttgtcaaattcataaaaacagaatgtagaatggtggttaccaggggttcagtggagtaggaaatggggagctgttgtttaatgggtatagagtttcagttttacaagatggtgtttggtcacacaacagggtaattatatttaacagtaccaaactgtattcttaagagggattaaggtggtgaattttattttgtgtgtcttttaccacaattattatttttaaaattttatttttacagtgacacggtctcactctgtcacccaggctggagtgcaatggctctatcatggctcactgtagccttgagctcccaggctgaagcaatcctctttccacagcctcccaagcaactgggaccacaggcacatgccaccatacctggctttttttttttttttaatatttttttttaaagtcagggtctcactatgttgcccaggctggtcttgaattcctggtctcaggtcatcttcctgccttggccccccaaagttctgggattacaggcataagccaccacacccagccaaatgttttttaattttaaaaataaaataaattgtataggtagaattaaaaatacataaatcagatcatgccaaccctttaaagtcatctagtgtgcttaagataaaatttaaaatccttttaaaaaagatttaaaaatgtatagtaaatgcccacatgattctcacagttaggtgtgcttctttcattgtattaaggatgtataaattttataagactaaatatcgtgagatatttattattgaatatatagcaattcaaaatacagtagtccctccttttctgcaagggatacattccaagaaccctagttgatccctgaaatcacagatgttactgagccctgtatataccttgttttttcatttatatacatacctatgataaagtttaacttataagttaggcacagtatgagattaacaataactaataataaaatagaataattataataatataagttatgtgaatgtgttctctgtcaccctctctcataatattatattgtacagtactcacctggttttagacatcagttgatcataagtaactgaaactctgtaaagagaaaccacacataagggagactactgtattttatgaaatatgtatgtgcatattaaatggaaaatgttttaaaaatattcaaatgttaaaacattgcaaactgatttaaagatccactcacaaaggcaatcagcttgcaaattcaaaggaagttgctattacctgtattttctcagttataccacagtggagctattcataatgtatcagaaagctaggcgtcacagttggatattatgtatataaatcagttgatttttgactcaaataactgaagtgtgttttggagataagttttatgattggaattggaaatgactgaattttgtggagcaaagcttttaactgtgttcacttggagatattctatagtgctttgactctggtttactactgtgcccagtggggtagatatttttttaaaaagacacgtattcaggaaaaaattttatttataaagattacaatatttgctcttgaaaataagaaataatgttagtcaaagaagccctgaatattactgtaaatcattgtacatgtattagtccttatggatttctttgcactagtaaaaatataattattcattttatttatataaggtctttgtgctgctgtaagaaaataccaccaatggtaatttacagtcaggcactgcatatttcaatcagtggtggacaacatgtgcaaaggtggttgtagaagattataatacagtgtatttactgtattttctgtgtttagataggtatttaccactgtgttacagctgcctacagtaacatcttctataggtttgtagcctaggatcaataggctatactatatagcctagctgtgtagtaggctatactatttagatttgtgtaagaatagactgtgaggttcacacaatgatgagatcacctaatgtcatatttctgagaacatatccctgttgttaagcaatgcatgactgtataagaaacactcaataaataatgtatggtagaaggtgattaaataccaaaataaatgaaaaccattaaagtgggcttaaaaacaaagtctcataattttagttactcatcacataaaaatgctttagttgttgcctgttccctaacagataagtgaatgttcacctaaggagactcaggagaaatccccaatactgagacaaacccagagattgagggataactgttctgattcagagggttttgtttgatcttacccctaaactttacaatgaaagtatgtttggtaatacagttaatataaaaatcagggttggctgggtgtggtggctcacgcctgtaatcctagcactttgggaggccgaggccggtggattgcctgagctcaggagttcgagaccagcctaggcaacatggtgaaaccctgtgtctactaaaatacaatcgaaattagcagggcgtggtggcgtgcgcctgtagtcccagctactcgggaggatgaggcaggagaatcgcttgaacctgggaggtggaggttgcagtgagccaagatcacgccactgcactccaacctgagcaacagagtgagactccatctcttaaaaaaaaaaacaaaaacaagcaggggtccccgacccccggaccatggaccagtagcagtccgtgacctgttgagaactgggctgcacagcaagaggtgagcagcagatgagcaagtgaagcttcatctgtatttacagccactccccactgctcacattagcacctgagccctgccttctgttagatcagaggcagcattagattcttattggagtgtgaaccctattgtgaactacacatgtgagagatctaggttgtgcactccttatgagaatgtaatgcctgatgatctgaagtggagctgaggcaatgatgctagcgctggggaacagctgcaaatacagattaacattagcagagaggtttgactgcacagagaccatagtaaatcaattacttgcagactcatttcaaaacccaatcagtgagtggcaggtggcaagctgcatctgacgtcaagctttatagtggcaagtgaggtgatgtacttcaattgtacagctgcatctggtggtaacgctttaagtcagaatccagcacttcttttaattcatgagtggcctgcttattattttatttaccactttcatctgcttctctttcctgcattacacacttttcttagtcagagttttggtaaacccaccagctaaccctacccaaaataagtaaaagccaaacatcactggagagcttctttgaaaagggagacagacccaatgatgagatagcagaagactctaagactgccaaccaaaaaaaaaaaaaagctgcatttaaaagaaaataccgagagtcttacataagttatgggttcattgcagtaggtgatttcacattctcagagcctgctttgtgtaatatgtggtgactggctgtccaaagccatgaaaccttcaaaactgcttcaccacatggagactacacgccctgcattagaagacaagcctttggagtttttcaaaagaaaagaacatgaacataaagaacagaagcaattactaaaggccactatttcatcaaatgtgtctccactgagaccatcattcttagtggctaaccacattgctaaagctaaggagccctttacatgaagagttgatcctgcctgctgctaaggacatatttcatgaacttttaggagaggctgcaattcaaaaggtggcatatcttcccctttgagctagcaccctaactagacgaatcaatgaaatagcagagtacatggaggcacaactgttagagaggattaatgaatcactgtggtatgcaatccaggttgatgggtctaccagtgttgacaacaagggaacaatgcttgtttttgtatgatgtatttttcaggaggatatacatgaggaaatgttttgtgtgcttttgttgccaaccagcaccacagctgcagaactattcaagtctttgaatgattacatatcaggaaaacgaaactggtcattttctgtcagcatatgcacagatggagcagctaccattacttgacagctttttggtttcactacttgggtcaaagaggtcgcttctgaatgtgagcctacacaccctgttatccttagagaaatgctggctagccaaaaaatgtcacctgaacttaacagcattttacaggatgtgattaaaattatcaaccacattaaaatacatgcccttaactcacatctgtttgcgcagctctgtgaggagatggacacagagcacacacatcttctctaatacacaggagtgagatggttttctaaaggtagatcactggccagagtttgagttacaagagccgcttcagagatttcttttaggagaatagttcttttcttttagaaaaacaatcaccactggcagcacatttcagtgacacagaaagggtcccaaaacttgcttacttgtgtgacctattcaacctgcacagagaactcgatctgtcgcttcaggggagaacaacaagtgtgttcaagtcggcagataaaatggctccattcaaaaccaaactggaattatgggggtgatgaaggaacattgggatttctgacatgtttcaagcattagcagagattttgagagactgagccagggctgcctttctctcagctagtgtatgatcacctatctcggctttcaaaagagttgagtattacctcccaaccacaaaagacccccgaactggaaggaatggatttgtgacccattcctgaataagtcaggtgaattgcctttgtccttgctagaagaggatccactgcttgacttcaaattatggtggccttaaaagtatgtttgagacaacttcaaatctccatatgttctagactaaagtcaaggcggaatatcctgagattgccacaaaagcactaaaaagcctgcttccattgccaacatcctgtctttgtgaagcagggtttcctgcagtgacagcaaccaaaatgagattatggagcagactgaatataagcaacacattttgggcgtcactatctcccatcaccccgagatgggaccatctagttgcaggaaaacaagctcagggctctcactgattcaacattatggtgagttgtataattatttcataatatattacaatgtaataatagaaataaagtacacaataaatataatgtgcttgaatcatcctgaaaccacttccccacccccagttcacggaaacattgtcttccatgaaactagtccctggcgccaaaaaggttggggaatgctgaaaaatgaaatccatctttctttgcattctttcaaaagattgagtctttcagaatatagaggggggcctataatgggatatattcattaactcatgcaacaaatatttattaaacacctatcatatgccaaacattgtggttaccagggagatagagtgataaacaatatagacatttgcaaaatattcacttcattcccctattgataagcattgatgcatcctgtgtcatatagaaaaggaggaaaattattattcggtaatattatagaacttaatgcaatttaagcaaatgcgtgtatacaaatgtgtatattttgtatatatttgatataatataccatatatatataatatcattctatgtaacctaccacatgttcagaatctgctgcagagattttttctgtgacacaaagaaacattaaatgcttatgcttcttttgttttttgtgggtttttttttctgtttttaaactagggatttggttatcctgcaaattatgaatttacttttgttttaatattctaaagctatacattaatattatttgccacatattggctgagagctattgaatcctttatagtgtaacattcttggcctaacagtctgcatttcccaggctgccagcaaagcaattcggtggggcaattgtggtcatgcaggggccttgtgagcggttggcagagagagaagcatacagatcagacagactcctatcctgcaggaaaggtagccctcctttctcccatcccagcagtcagcaggaggtagagccgctcagagctatatgaagagcctttgggaataggtgcctatggttatgttttgctgcagctgccctatattcacaacctcctgcattccatgcaggcttgacctctgcctctgcctattctctgggcagttctccctgtcaattcagctgtctgggggtcatgggatcccagaggtagctaggatgccagtgtgtttctctgcagttccttcacttacacctttcttaggaactgttgagggctgggagctggtcctggtactcggcaatgttttgcagtgttcccagcatcctccctcttctacctcagtgtcagtagtacctttctatcaactttcagtgttttctttaaaaagaaagtgtgatggtttactggatattttgggttcagtgaagtgggagaggcactttctggctgcatttagtcagccatcctgctccatagtcattggaattatctttctaaattttattttctgattgttgttcctggtatataaaattataattgattttttaattaaactttttagatagttgtagaattacatgtggttaaaatattttctaaagagagatcctctgtaccctctatccagtttcctcaaatggtaatatttagcaaaacagtacagtgtcacaatcaggagtttgacactgacccagtgaagataaaggacattttcatcaacacaaggatccctcaatttgcctatttgtaaaatacccacttccctttccccatctcccacctgaactccttgtaaacactaatttgttctccatttctataatattgttaaatcaagaaacttatataagtggaatcacaccacatgtaatcttttggggttgtgtactttctattagcataattatctagatatttatccatactgtatatcaggcgttggccacattgtatgacagagaagtattccatggtatggatgtgccacagtctaacattcactgattaagggaaatctaggttgctttcaattgtgggtaaatacaaaactactgtaaccccctatacaggttttgggtattaacacagttttcttttctctgggataaatgtccaggggtgcaatagcagagttggcatggtaattgcctatttaattcttaaaataactgctaaaatgtatgcagaatgactgtaaaattgtgcattccaaccagtgaactatgaatgatccaattctttccatcttcaccagcattttttagtcactattttaaaaaatgtagctattgttatagatgtgtgatgatatctcattacatttttttgtttgtttttgtttttttgagacagtcttgctctgtcacccaggctggagtgcagtggcacgtgtgactcagtctcccaagtagctgggattacagatgtgcgccaccatgcccagctaattttcatattttaagtagaggtgaggtttcagcatctatggtctcgaacccctggcctcaagtgatccgcctgcctcagcctcccaaagtgctggaattacaggtgtgagccaccacgcctgttcttattatgattttaatttacattttcctaatgcctaagatgttgaatgtattttccatctgcaaatcctcttgaatgaaatgtctctttataccttttgctcattttctgctttttttgttattgtcatgttcgagggttctttatattgtctgcatgccagtgttttcttggatacattgtttgcaaaatgttcttgtttcgtagcctcttctttcactttcttaccagggtttttcacacggtgaaagttttaaattttgataaagtacagtttatctatacttccttttatggatggtgctttttgtgtcaagtataaaaattccttgtctagcactactccagaagattttctcctatttttcctaaaacttttatagttttacacttcatatttaagtacaatgtccattttgagttattttttatgtaaggcatgagataggtcgaggtttttgcctatggatatgcacttgctccagcaccatttgttgagttgcttttttacttatgtgtaaaatcggttgggcatatttgtgtggggtctattcctggtttctctattctgtttcactgatttatatgtttatctttctggctaataccacacagtctttattattatatctgtatatgtcttgacattgagaagactgatacctcacacttaattctttttcaaaattgttttagctattataattcctttgcctttccatgtaagttgtagaataatattgtctatgtatactaaaaatactcactgtaattttgattggtaacaagctaagcttttgttattaatttggggagaattaatatttttaaatgttgagtctaacaatctgttattctgtatatttatttattagatctttgatacctttcaccaacattttgtagttttcagcacgcaagccctacaacgttttgtagatgtacacctacctatttcattttttttaagcaatgataagtggcattatattttaatttaaagattcatgtgtccatggctaatatatacaaatgtaattgattttcatatatcagtcttgtatcttgtggccttgaagaactcccttattctaggagttttttctaggttccttgggattttctatgttgacaaatgtgccatttgcaaatagggacagtttatctccttctttccagtctgtttgcttcttatttccttttattgccttactgcacttgctaaatattatttacttcattgaataagagtagtgagagcatatatctttttttttttgttcctggtctttggggaaagcattcagtctttttatcattaagaatgatgttagtagatttttaaacaatgctattttttaccaagttgaggaatttcctttttcttctcatctttttgagaatttttatcatgaattggttgaattttgtgaaatgctttcccgcattgattctataatcatgtgattgtgtttcttcaaactgttaatatgatgttttacattgattgatttttgaatattgaaccagccttgcatacatggaataagcaccatttagtcacgatatatagttctttttatatgtaattctgaattcttttactaatattttgttaaggatcttttggatatatattcacatgagaaatatttgtctttgggttttgttttattatactgtctttgtttgctttttgcatctgcgtaatattcccttcataatatccatttggatattccctcctttgattttctgatagagatggtttagaattggtgtaaattttgtgagtatttgtttggattttccagtgaaagaattattgcctagacagtttttggaggagttttaaaatacaaatccaatgatcttaatagttgtaggtctattcaaattactgatttcacattgggtgagtatttggtagcctgttgttcttttgaggaattgcctgtgtctcttaggttaacaaactgatgtgtgtagagtggtttgtagtatttccttactatccttttgattcctacagagtcggtagtgatatctctcctgtttctttcgtgatgtgggaataggtgtactttattttattgggctttacattttgactctgctcaaagattgtgctttttacatatcaaaggtttatggcaatcctgcatcaagcgagtctgtcagtgccattttttcaacagcatgttttcattttgtctctgtgtcacattttggtaattctcacaatattttaaactttttaataatgactgtatctatgatggtgatctctgatcagtgatgtttgatgttactcatacaattgttttggcttaccatgaaccacatccatagaacatggtgaacttaatcaataaatgttgtgtgtgttctgtttgttccacttaatgaccatttccccatctctttctctctccatgggttttcttattcactgagacacatcaatactgaaattaggccaaataattaccctacagtgccctttaagtgttaaagtgaaaggaagagctacatatctctcactttaagtgaaaagctaaaagtgagcaaatttactgagaaaggcatgtcacaagccaaaacaggtcaaaagctaggcctctcgcaccaaacacttagccaaggtgtgaatggaaactaaaagtttttgaaaaaaggtaaaagtgctgtttcagataacacatgaatgataagaaagtaaaacagcttaattgctaataaagagataattttagcagtctggctagattggactagccacaaaattttcttcagccaaaacctaatccagggcaaggcccgaattctcttcagccctacaaaggctaagtgaggtgcagaagttgcacaagaaaagttggaagctagcagaggttgcttcctgaggtttgaggaaataagtcatctctgtaacataaaagtacaaggtaaagctgcaagtggtgatttaaaagttgcagcaagtcatccataatctagctaaaatcattgatgaatctttagtggctacactcaacaacaggttatcaatatagatgaaatagccttctgctgtaagaagatgccatctaagactttcatagctagagataagatatcaatgcctggcttcaaagcttaggctgactcatgagttagtggctaatgcagctggtaactttaaattgaagccattgctcatttaccattttgtaaatcataggtcccttaagaattatgctgaatttactcttcctatgctctataaatgaaacaacaaagctaaatcacaatacatctgtttacagcatgatttactaaatactttaagtccactgttgagacctactgctcagaaaaatagattaaaaaaaatactgctgctcactgacagtgcccctcgtcagccaagagctctgatgaaaatgtacaaagagaataatgttgttttcatggctgctaacacaacatccattctgcagcctatggattagggagtaattttgagtttcaagtcttattatttaagaaatacattttgtcaggctatagctgccatagatagggattgctgtgatagacctgggcaaagtaatttgaaaacattttggaaaggctcaccattctagatgccattcataacattaatgattcatggagggagttcaaaataccagcattaataaaactttagaaattgattcgaccctttatggatcagttcgaggggtttatgacttcattggtggaaagtagctgcagatgtggtaaaaatagcaagagaaatagaattagaaggagagccggaagatgtgactgaatttctgcaatctcatgataaaattttcacagatgaggagctttttcttatggataatcaaagaaaggtgttccttgaggtggaatctactcctggtgaagatgctgtgaatattattggaatgacaaaaaaggatttagaatatgacataaacttacttgataaaacagtggcaggatctgtgaggattgactcttccaattttgaaaaaaattctgtgaataaaatgctattaaatagcattacatggtacagagaagtattttgtcaaaggaagagtcaacctgtggggcaacttcattgttatctttctgttgcaaccaccaccatgatgagttagcagccatcagcatcaaagtaggaccctccactaacaaaaactttacatctcattgaagggttagatggtcattagcattttttgcaataagatcttttaaaatcaaggtatgtacattttgaaaacgtaatcctattgtacatttaataaactgtagtatagcataaacataactttatatatgcactggaaaaccaaaaagttgtgagacttattttgtcataatattcattgtattgtggtggcctagtactgaacatgcagtacctccaaggtgtgcttgtaatttgtttcttttctgtttttctctttgtcagtcttagaggcagctttttttttttaagatccagctttttgtttcattgttttattattttgctgtttttaatgttattggtttgtgctctttattatttccttctttctgcttgatttagttttattatgcttgtcaatttctagattttatgcttatattattgatttgagacttttactgttttcaaaaaaatgcacttattgctatattgtccgtatagcactacttttcctctattccaaaatttttgatatatcttattttcatattttttttcagtttacagagtgtgtgtgtgtgtttgtgtgcacgcgtttaatttctcttgagatgtgctttttgtttcatggattatttagaagtctcttgtttagatttcaaatctgtgccttgtctggtatgtttctgttgtttccattctggtcaaataatattttgggtattatttcaattattttacaataattgatttttcttttaagatacagaacatggtctatattgaaataagttctgcaggcatgtatttgctggttttgactagagtgttctttaaatgtcagttatgtcctggtggttgatactgttgagttcttctgtatctttgttgattatataactagttctttctaattttgtgaggcttcttgatgtctccaactatgtttatgtcttttctttcattttttcaggtatatcagttttgcatcacatgttttgcagctttgttgtttgttatatacacctttaggattgttttgtcttcccgatggattaatttttttatcattatgtattgtgcctctctgtctctggtaatttcttttcttttgaagcctactttacctggtattaatacagccactcctgctttcttatgtctacttggtagatctttttccatgtttttatagtcaacattcttgtatctttatatttttagtgagtttcagatggagagcatatttttgagtctgcctttaaattcactctgctaatctctttcagttggtgtatttacaccatttacatttatataattaattatctgtaggagcttaagtctcccactgtatttcttgtattttgtttgttctcacttgtttctctttttcctttttcctttcttcttgggagttatttgaatatttttaggagtttcatttttatttataaatatttttaatgatatctcttttctagtggttgtttattggttactctagtgtatgtgtgtgtgtgtgtataaaattttatcaattttatcaattcatgtgaagtgtaggaaacttaaatttatatctcattaccctctcaatacaattgcctgaaatatttcttgtacgtacatatagactcacattagacagtgagtctgtgagagtctataatagtttcctgaaatattttgtacatacatatagactcacattagacaatgttacagtttttgcttcagcattcaaacataaaagcccaagatgagaattttgtctgttgtatttacccatatatttgcctactattataatgtttttcttcctgatgttccaagagttcttatttttttgcttactttatgtttagaaatctttcattgaccattatattagggttggtatgctggtaaaaagttttcttagtttttcttcatcaaagaatgtcgtaattttttttttcatgtctgaagagtatttttactggatataggatgtgggttcacagttcttttatttaagcacttcaaaaagtacttccagtggggcgccaagatggccaactaaaagcagctatggtgtgtggctcttacagagaggaacgaaagggacgagtaaatgcagcacctttaactgaaacatccaggtacttgcattgggactgatcagggaaacaactcaacccacagagaatggagaagagcaggacagggcagggcagggcaacagcttacctgggagcaacatggatacaagagaacctacccctgcccagggaagcagtgagtgaatatgtgaccctgggaaaccatgcccctcccacagatctttacaagtccggtcaggagatccccttgtgaatccattccaccagggccttcggtctgacacacagaactgtgtatagtctcaacagaaaagctgctcaggcatgcatggagacccgggaactttacatactctggctctagtatccctaacaaaggtgattgcaacttaggcagggcgggagcttggacatccatatttacccctaggaagggatctgaatccagggggctaagaagcattgatctgtgggccccatttccacagcttctcacaggataagacccactggcttggaatttcagccagcccccagcaacagagttgtacctacctgggacaaaacagagttgctggcgggaggggcagactaccatctttgctgcttggataactcagccattccagcctgtgggcttaggcgagtccaaaccaactgggcatggaagggatcacctagcacagcaaagctgctctaccaaaatgtggccagactgcttctttaagagggaccctcaatccaaatcctcttcttgggtgttacctcccaactgacagagttttgatttctctttgggactgagtgcctgcggggaggggcaggctaccatctctgctgtttggacagctcaacctttccagcctgtgggctttggagagtccaaaccgaccagggcagaagggatcccccaacacaacacagctgctctaatacaacatggccgactacttctttaagcagaaccctgatccgttcttcatctctgagcaggacctcccgactggaccctccagccaccctcacttgtattctctggttcacaatgttttgatttcaccctgggactgagttcgagggggaggtgggcgggcgccatcgttgctgtttgggcaactcagcattctgtcctgtgggctttggagagcccacgcccaccagggcagaagcagtaccccagcacggcacagctgctctatgaaaccatggccatcctgcttccttaagcagtccccgatctattcctccttgcagggcgggacttcccaactgtgtcctccagtcactcccatggatgttctgtggctaagaggtttgaaaacttcctgggacagagctcctagagggaggagtgggctgccattttttctgtctcagcaacttccgtagtttacagactttggagagcccaagctaactaggggcagaagtggtacacccacacagcacagctgctttataaaagtgtggctagactgcttctttaagcagatccctgatcccactcttcctgactgggtgacacctcccaaccagtgtctccagccaccacctaccacctggttgtttgggccagcaaccaggtctgtacccctctgggacagagctcccagaggaaggggcaggctgccatctttgcagttttgcagccttcactggtgataccctcaggtactggaaaacctaaggcgactagggactagagcagatgcccagcaaaccacagcagccctgtgaaaagtggccagactgtaaaaaggaaaaaaaaaaaatccaaagatcagcctcaaagattgaaggtagatgtgcccacaaagataaagaatcagcacaagaacgctgaaaactcaaaaagccacagtgccctcttctgttcagatgaccacatcacctctccagcaagggtttggaattgggcagaggctgagatggccgaaatgacagaagtagacttcggaatgtggataaaattgatgttcattctgctacagctgcaccttctaactcaatgcaggaagctacagatcatgataaaacatttcagcaactgacaaggtaaaatagccagtatggagaataacgtaagcaacctgatagcgctgaagaaaacaacagaagaagttcataatgtaattccaagtattaatagcagaatagaccaagtggaggaaagaatcccagagcttgaagactgtctttctgaaataagacaggcatacaggaatagagaaaaaagaatgaaaaagaatggacaaaacctctgagaaatatgagattatgtaaagagactgaatatatgactgattggtgtacctgaaagagatgagaagaatggaaccaacttggaaaatatatttcaggatatcttccatgaggacttccccaacctagctagacagaccaacattcgatttcaggaaatgggagaacccctgtaaaatattccacaagaagatcatccccaagacacataatcatcagattctccaaggtcaaaatgaaagaaaaaatgttaaggacagccagagagaaaggccaggcaacctacaaagggaagaccatctgactaacagcagacctctcagcggaaaccctacatgtcagaagagattggaggccaatattcaacatgctgaaaaaagaaaaattccagcccagaatttcatatgtgcccaatctaagcttcataagcaaaggagaaataagatactttccagacaagcaaatgttgaggaaatttgttaccaccacacctgccttacaatagctcccaaaagaagcactaaatatggaaaggaaaaatcgttaccagccactacaaaagcacactggagtacacagacaaatgacactataaagtaaccacaagttattttaaacaagtctccaaaataaccagctaacatcataatgacaggatcaaatctgcacataacaatactaacctcaaatgaaaatgggataaatgccccaattaaaagacacagagtggccagctggataaagaaacaagacccaatggtctgctgtcttcaagagacccatctcatgtggaatgacacacataggctcaaaaaaggatggaggaaaatttacaaagcaaatggaaaacagaaaaaagcaggggttgcaatcctgttctgacaaaacagactttaaccaacaaagatcaataaagacaaagaagaagggcattacataatggtaaagggttcaattcaacaagaagaactagctatcgtaaatatatatgcacccaacactggagcacccagattcataaaccaagttattagagaccttcaaagagacttagactcccacacaataatagtgggagactttaacaccgcactgacaatattagacagactgagacagaaaattaacaaagatattcaggatctgaactcagatctggattaaatggacctgatatatatctacagaactctccactcaaaaacaacagactatacattcttctcatcaccatgtggcacttactctaaaaaagatcacataatcggaagtaaaacactgctcagctcagcaaatacaaaagaactgaaatcataaccaacagtctcttggaccagagcacaatcaaattagaactaaagtctgaagaaattcactcaaaaccacacgattgcatgaaaattaaataacctgcccctgaatgacttttgggtaaataatgaaattaagatggaaatcaagttctttcaaactaataaggacaaagatacaatgtaccagattctcagggacacagctaaagtagtgttaagaaggaaatctatagcagtaaatgcccacatcagaaagctagcaagatctcaagttaacaacctaatgtcacaatgaaaagaactagaaaatcaaaatcaaacaaatcccaaagctagaagaagacaagaaataaccagaatcagagctgaactgaaggaggtagagacaagaaaagccattaaaaacatcagtaaatccaggagttgtttttttgaaaagattaataaaataggccactagatagactcatgaagagagaatcaaataaacacaatcagaaatgataaggtggatattacgattgtccccacaggaatacaagcaaccatcagagaatattataaacacctctatctgtatcaactagaaaatctagaataaatggataaattcctggacatatacaccctaccaaaagtgaaccaggaagaaattgaatccctgaacagaccaataacaagttctgaaattgaggcagcaataaatagcctaccaaccaaaaaaaaaaaaaaaaaaaaaagcccaggaccagacggcttcacagctgaattctaccaaatgtacaaagaagagctggtaccattcctactgaaactattccaacaaattgaagaggagaaactcctccctaactcattctatgaggctaacatcatcctgacaccaaaactttgcagagatacaaaaacaaaagaaaacttcaggccaatatccttgatgaatactgatgcaaaaatcctctgcaaaattctagcaaactgaatccagcttatccaaaaagataaatcgagctttatctcaaaaaactgagtgaacaggcaacctacagaatgggagaaaatttttgcaatctactcatctgacaaagggctaatatccagaatctacaaagaactcaaacaaatttacaagaagaaaacaaacagcaccatcaacaagtgagcgaaggatatgaacagacacttctcaaaagaagacatttatgcagccaacagacacatgaaaaaatgctcatcatcactggccatcagagaaatgcaaatcaaaaccacaatgagataccatctcacaccagttagaatggcgatcattaaagagtcaggaaacaacaagtgctggaggggatgtggagaaataggaacacttttacactgttggtgggactgtagactagttcaaccattgtggaagacagtgtggcgattcctcagggatctagaactagaaataccatgtgacccagccatcccattactgggtatatacccaaaggattataaatcatgctgctataaagacacatggcacacatatgtttattgtggcactattcacaatagtaaagacttggaacctccccaaatgtccatcagtgatagactggattgagaaaatgtggcacatgtacatcatggaatactatgcagccataaaaaaggatgagttcacgtcctttgtaggggcatggatgaagctggaaaccatcattctcagtaaactatcgcaaggacaaaaaaccaaacaccgcatgttctcactcataggtgggaattgaacaataacaacacttgaacacaggaagggggacatcacacaccggggcctgtcgtggggtagggggaggggggagggatagccttaggagatatacctaatgtaaatgacgagttaatgggtgcagcacagcaacatggcacacgtatacatatgtaacaaacctgcacgttgtgcacatgtaccctagaacttaaagtataataaaaatatatatatataaaatattaataaatattgaatcttccaaccacccaaaaaaggaaaagaatgcacaatatcttattaataattttatatggtttacattttgaaatgataacattatgaacttactgtattggattaaataaaaacattttttaataaaaaaaaaagcttgtccaccagagttaaataggctttatccctgggatgcaaacttggttcatcattgcaaatcaataaatgtgatttatcacataaacagaactaaagaccaaaaccacttgattatctcaagagattcagaaaagatttttgataaaattcaacatccctttacttgaaaaactctgaccaaactagatactgaagaaatgaatatacctcaaactaataagagccatagaagacaaactcacagccaacatcatactgaatgggtaaaagctggaagcattctccttgaaaaccggcacaagacaaggacgccctctctcaccgctcctgttcaacatagtattggaatttctggccagagcaatcaggcaaaagaatgaaataaagggcattcaaataagaagagaggaagtcaacctatccctgtttccagatgacatgattctgtatctagaaaaccccagtcgtctcagcccaaaagcttcttaagctgataagcaactttagcaaagtctcaggatacgcaattaatgtgtaaaaatcactagcattcctatacatgaacaacagtacaagtgagagccagatcataaacgtactccccttttcagttgccacaaaaagaataaaatacctaggaatatagctaacaacaaagcgaaagatctctgcaaggagaactataaatcactgctcaaacaaatcagaaattacacaaagaaatggagaaacattccatgctcatggataggaagaatcagtattggtaaaatggccaaaatgcccaaagcaatttataaattcattgctattctgattaaactaccattgacatctagttctgtaaactaccattcacagaactagagaaaactattttaaaatttgtactgaaccaaaaaagagcctgaatagcccaagcaatcgtaagcctaaaaaacaaagctggaggcatcacactacccaacttcaaactatactatggggctacagtgaccaaaatagcatggtagtggtacaagaatagacacataaccaaaggaacagaatagagaatccaaaaataagactgcacatgtacaactatctgatcttgaagaaacctgacaaaaacaagcaatggggaaaggattccctattcaataaatggtgctgggataactggctagccataggtcgaaaattgaaactagacccttcctgacaccatacacaagaattaattcaaggtggattaaagacttaagtgtaaaacccgaaactataaaaaccctggaagacagcctaggcaactacattcaggacattaggtactggcaaagatttcatgacaaaagtgtcgaaagcaattacagtcaaaccaaaaattgacaaatgggatctaagcttctgcacagctaaagaaactatcaacagagtaaatagacaacctacacaatggcagaaaatttttgcaaactatgcatctgacaaaggtctaatatctagcatctataaggaacttaaatacatttagaagaaaaaccaccccattaagacatgtgcaaaggacgtggatacttctcaaaagaagatgtacatacagccaacaaacatatttagaaaagctcaacatcactgatcattagagaaatgcaaatcaaaaccacagtgagatatcatatcctaccagtcagaatggctattattaaagagctgaaaaataacaagacgcttgtgaggttgtggataaaaggaaggcttatacactcttggtaggagtgtaaattagttcagccattgtggaagacagtgtggcaattcctcaaagacctaaaatcagaaatagcatttgacccagcaatcccattactgggtatatacccaaaggaatataagttgctctgttataaagacacatgcacccatatgttcattgcagtacttatgacaatagcaaacatatggaatcaacccaagtgcccatcaatgatagactggataaagaaatgtggtacacatacaccatggaatataaggcagccacaaaagagaatgaagatatgtcctttgcagggacacggatggagctggaagtcattatccttagcaaagtaacacaggagcagaaaaccaaatattacatgttcttacttaggaatgggaactgaatggtgagaatacatggacacgtatagaggaagaacacacaccagggcctacttgagggtagaaggtgggacgagggacagtatcaggaaaaataactagtggatactagtcttaatacctgggtaatgaaataattgttacaacaaacccccatgacacacgtttacctgtgtaacaaaccttcacatcctgcacttgtacccgtgaacttaaaaaagaaaaagtgcttccttctagcctttctggtttctggtaagaaattgattgtcatttgtattacctttcccactttcctgctgttttttttttttttctttttttgagacagagtgtcgcactgtcgcccaggctggagtacaatggcgttatctcggctccctgcaacctctgcctcccaggttcaagcaattctcctacctcagcctcctgagtagcagggattacaggcagggtttggctatgttagctaggccggtcctttcctgctgtttttaaggtatttccagccgggcatggtggctcacgcctgtaatcccagcactttgcaaggccaagacgggtggatcagctgaggtcgggagttcgaggccagcctggccaacatggagaaaccccatctctactaaaaccacaaaaattagctgggcgtggtggcgcatgcctgtaatcccagctactcaggaggctgaggcgggagaatcgcttgaacccaggaggcggaggttgtggtgagccgagatcgtgccattgcactccagtctgggcaacaagagtgaaactctgtctcaaaaaaaaaaaaaaaaagatatttcctttgtctttagttttcgaatatttggccatcataaatcttggtgtggatttcattaactgtaccctctttcaggttttttaaactcttgaatctctatattgagttgttatttttttttaaatgtatcctatccttttatccctcttctttgacactcagatgatattaactttagttcttttgttattgtttgacaattcttggggactttatttttttttccaaaccgttttcttcttttccagattggatgacttctagtgtgttatctcctagcttgctgattgttttcgcatgtttctttcattctagtattgagcacatccattaagttttgtatttcagttattgtgtttttcaggtataaaatttctatttggtcttcctgtgtatcttctacttcttgattaagattctttttctttgctgtgactttttgctcataaaatttgtttcatgtgtttttataattcctttttgaataatttttatcatgacaagactaaaattttttcaggcaactctagcatctctgctgccttggtcttagcacctgtcattagccttttttcattcagtttgagatcttcctggttctttgtatgacaacttattttttaataaaacctgaacattttgggtcttatgagaatgtagtctttatttaaattatctggtgtagctgtctcattctgacacttcatctgagagtagtccctctacctctttgctccaaggttgaggtgggagtcgggttttttacttggcctccttggtaggtaaggcggaaggttttccatgttactgctgtgtaggcatgttagttttggctccctggtaggtctccagtgaaccccttttggctaggattggtaggagtatctttgtggggttggttgaagatgtttggaagatttcatgtagaacttgagttttaatatgctttcaccagaaatataaagcagtggaggagatcataaatcaatttgcatcctctctggaaagccataggcatatgctatattcatgcatgtatcagaaattacaatattaactggctctctataatgcctcgtaattttactggttcttgtcaaaaagtggttagtaaacgttttctgccaggtacagtggctcatgtctgtaatcccagcactttgggaggccgaggtgggtggattgcttgagcttagaagttcaaaccagcctgagcaacagcgaaacccagtcttaacaaaaatacaaaaaaatttagctgggcatggtggcgaacgcctgtggtcccagctacttgggaagctgagggagaaggatcatttgagcctaggcggtggaggttgcagtgagccgagatcgcaccactgcgttctagcctgggcgacagagcaacactccatctcaaaaaataaataaataaataaaaagaggccatatgttaaatattttagattttgtgggccaagaggcaaaattgagaattgtacctaggtacttataagaaagaaaacaaattttctcagatttttttgatttatgaaatcaaaatttactaatagtaatggagtacaatgtttataatttgtgtttactaatatgaagaatgaaagatggtggaaataacagtttagagtttatgtttagtagggtttatagtttgtgttccctgtcatcaaaattagttgcacatgttcatctgttaatgctaatctgtatggagtattttatccttgcaaatgtcttttcatgaaaattgttattggcacatactaatcttgatccattatcttgatttaacttggcatattaatcatttggaatacatttttagaattctgttaggttttcgtgcctttgagcgtgtcattgcattacagattaatcacttaatgaagataagaagtggaaagttctcagttgtagagttaaatagacttatggaaatttcctttcagtttgcatgaggtcaaaaatatttggctggaaatgtaatttgaaaatttatctgctgcccgtttgtcaggaaaggagattttgcttctttaacttttgtcagaaaaagaatgtgttaactttcaacagcataaaacagcttgaaagtacttagaattcaaacaatgtttgcagttgttaaatgactatcgtaatataagttttgcatataatcattgttttggcttataattttagattgattacattaataccatgaaatctttacatcagtttctctttttgaatttttaaatgtatatgtaaaggctttattaattattgattcaaactgtttcttcttttgtgaactttgatggtgtctttaaggaattggtttattccatcaagattatcagattcttgattcatgtcttgttcataatattcctttattatccctttaatgtctatgacatctgcagtgatgtttcctctttgtttctgatattcatgatttgtgctttcagtgaacttggcgagaggtgtattgattttatcaaagaatcaccttttggtttcattcatttttctctttagatttcccattttcagttgcattgatttctgctcaaatttttgttatttatttgcttctgcttaatttggatttaagttgctgtcatatagctagtttgataaggtggaggcttagattattaattttaaatctttcttcttttctaatatatgcattcaatgttataaatttccctctaaacactgcttttactgcctcccttacattttgataaattatggtatcattatttaaataaaaatatttctaaatatattttgagatttatttttgacatgttctttagaagtgttttgtttaatctataggtatttggggatacttcttttattctcctgttattgatttctagtttaattccgttatggtctgagagccaacactataattttgtggtaagatgtgaacgtggtccttttggtgaatgttccatgttagtttgagaagagtgtctattctgcttttattggatgaagtcatcaatagatgagagtatatcaaattgattattagtgctgttgaattcagctatatccttattgatttttttcttgtgagatttgttcatttatgatagaggattgttagtctccaactgtaacaggggtttcatctattactccttgcacttctatcagtttttgcctcatgtattttaatgttccgttgttaggtgtatatatgctaaggactgttatgtattcttggaaaattcatccctttatcataatatattgcccctctttattcctgaaaacttttcttgctttgaaatctgctctgtctgaaattaatacgctaccttcactttcttttgatcagtgttagcatggcatttctttctccatcctttcacttttatctgtaagtatttttaaatttgaagtggattttttggtagaaaatgtataattggaccttatttttttaatctaccctgacaatctctgttttttaattggtgcattcggaccattgacattcaacatcgttattgatgtaggtgaattaatatctaccatattttaaacttttttatttgttgcctttgacctttgttcttgttttgtctcccactcttctaccttttgtgtttctaattgaacattttatgtaatttgaatttctcttttgtcatagcattatcagttaggcctctgtttttaatttttatttttattatttttttgagacagagtctggctctgtctcccgggctggagtacagtggcgcgatctctgctcactgcaacctccgcctcctgggttcaagcgattctcctgcctcagcctccctagtagctgggactaccagtgcgtgccaccacgcccgggtaattttttgtatttttagtagagatggggtttcaccgtgttaaccaggatggtcttgatctcctgacctcatgatccgcccacctcggcctcccaaagtgccggaaatacaggtgtgagccaccacgccctgcctgtttttattttttaatggtcatcctagagtttttaatacacgtttcaactaaacgaagtccaataacactatattcacaagcagtgtgagaaaataatcctaattcctctcttccacgcagtgtatgcttactggaattcatttaactttataaaagcatgcagaagaatacatgtgtatataagcctacataatcatatacattgttgctattattattttgaacaaactattatgttagataaatcaggaaaaagaaaaatttttactttaccttcatttatttcttctctaacgcactttatttaagaagatctcagtttctgactgataatcatttttcttctttctgaagaaattcttttaacatttcttgtatgtcagggctcctggcagcaaattagccaatttttttactgcccgagaaagtctttatttcaccttcacattttttcctttatttttagctgacatgtagtaattgtacatatttatagtctacagagtgatatttcaatacatttacacaatgtgtaattataaaatcagggtatttcgcatatccgtaatctcaaacacttaacaattctttttactgtgaacattcaaaagcttctcttctagttttttgaaaatatacaataaattctagtcatccatatttatactacagtgctgtaaagactagagcttactcctatttttcttttctttttttttttttgagatggaatctcgctctgtcccccaggctggagtgcagtggtgcgatctcggctcactgcaacctctgcctcccgggttcatgccattctcctgcctcagcctcccgagtagctgggactacagacgcccaccaccactcctggctaattttttgtatttttagtagagacggggtttcaccatgttagccaggatggtattgatctcctgatctcgtgatccacccgcctcagcctcccaaagtgctgggttacaggcatgagccactgcgcctggtccttactcctattatctacctttaagtttgtgttcattaaccagcctcttcccatccttccctacccactccccttctaagcctctagcaaccacaattctactctctacgtctatgacctctttttttgtttttaatggatactacatatgcatgagaacatgcagtatttatctctctgacttatttcacataacataatgtcctccagggtgatccatattgctgtgtatgaatgcatttaattctctctctcttttttatgactgaatagcaatcaattatgtatatacgacacatcattctctttatccattcatctgttgatggatgtttagtttgattccatatcttggatattgtgaatcatgcttcagtaaacatgggaatgtaagtatccctttgacataattgatttccttgctttttgataaatgcccattcctgtgattgctggatcagatggtaattaaatttttactttttgaggaacctccatactgtttttcataatggccgtactaatttacatatccacaaacagtgcataagttcctgtttctcttcgtcgtcaccagcatatgttatctttgatcttttataatagccattctgactggggtgagatgatatctcattgcagttttgatttatgtttccctgatgactagggatgttgagcattcattcatatatttgttggctatttgtttgtcttcttttgagatgtctattcagattctttttccagttttttttttttttttgacggagttttacgcttgttgcccatgctgaagtcgaatggcacgatctcggctcactgcaacctctgcctcccgaattcaagcgattctcctgcctcagcctcctgagtagctggggactataggcacgtaccaccacgcccggctaatttttgtatttttagtagagatggggtttcacccatgttggccaggatggtctcgatctcttgacctcatgatctgcccgcctcggcctcccaaagtgctgggatgacaggtgtgaaccaccgctcccggcccctttttccagtttttaatcagattttttgatgggttgtgtgagttccatatatattctggacattattcccttgtcaggtaaataatttgcaaatattttctttcattcaacagactatatttctttactctgttgatcttctttttttgctctacagaagctttttagtttggtatagttccgtttgtctatttttgtttttattgcctgtgcctttgaaatctttaaaatctttgcttagacagatgtcctgaagcatttcttatatgttttcttgtagttattttgtaatttcaggtcacaggtttaaatctttaatccattttgagttgatttttgtggtgagaaggatgtactttcattcttctgcatataaatatccaattttccaacaccatttagatattttattctttttagcaggtattgactgcaaatgggcttgctttcctgatttttttttcagctagttggttattctataaaaacatcactgattcttgcatgttgattttgtatcctgcaactttactgaatttgtttagaagttcaaagatattttatccttttatagattcaggagggatatgtgcaggtttgttacacacacatatatatatatatagcataatggtgggatttgggtttctagtttagtcatcatctgactagtgaatattgtacccaataggtaatttttcaaccccaacctcccctcttttggaatccccagtttctattatttttcttcctagagttttttgaagagtcttcaggattttttatatgtaagattatgtcatctgcaaagagggacaacttgcctttctcctttctaatttagatgaactttatttccttttgtggcctaatttttcttacaaggaattccagttctatcttaaatacaagttgtaaaagtatacattcttttcttgttctagttcttaaaggcttttagcttttctccattcagtgtgatattgtctgagtgtttttcatatttggactttattgtgtttaggtataatctttctatacttaattttttagagtgtttattatgaagggagttgaattttatcagatgctttctttggatttgagatgatcatatgatttgcttttcatctatcattctgttgatgtgatgtagcacatctattgatttttatatgttgaaccatcctcgcatacctgggataaattccactcaatcgtagtgtattttttttttttttttgatgtgcctttggattcagattcctagtattttgttcaggatttttgcatctatgctaatcatggatactgacctctagttttttttgtgattgttgttgcatccttctttagttttggtatctgggtactactgacctcgtagaatgaattaggaagaatttccacctttttaattttttggaagagtttcagcaaaatagatgttcttcttttaaagctttttggtcctgggctttttgttgggagacttttttattgccagtttaatctcgttactcattattgatctgctcaggttttctatttcttcctgatttaatttgtgagattatatgtgtccaggaatgtatccatttaatataagttttctaatttcttagtgtgcagttgttcataataatttctagtggtcctttgtatttctgttgtatcagttgtaatgtctcattttttatttctgattttacttatttgagtcttccttttttcttgattagtctagctactggtttgtaaatatagtttatctttcgataaaaccagtgtttcttgtgatcctttgtgggtttttgtctctatttacttctgctctgatgtttccttcttcttattttaggtttggcttgttcttccttttctggtttcttgaggtgctttgtcagattgattaagtgaaattgttcaaatggtttaagtgtttattgctgtaaacttcccttttagtactgtttctcagtacactataagtttttggtatgctgtttctatattaatttgtttcaagacttctttggtgtctttaaatttcttaattgaaccataagtttctcagggtcttttctctttttttcttgattaatcttattaatttttgattttcatgtatttgtagaatttccaaagttcctcttgttactaatttctagttttactccattatggtttgagaagacacttgatataatactgatttttgaaaatttcttgaggccagtcttgtggcctaacatgtggtctgtcttgtagaatgttctatgtgctgatgtcaaaaaatggatctaaaatggtttacaggccatatttggtccaacagctgcagttggaccaaatatgttctgtaagccatctttagatccatttggacacacatttttgaaggataactttgttgggtatagtgttattaatcagtaggtattttttgttttagtactttgcttaaaccattttttttctctcttggcttataatggttctgctgagaaatttactgttagtctgaaggggattcccttatatgtaacttgatgccttttgctgtttttagaattatttctttgtctttgactcttggcagtttgagagatatatgtctcagggatgacatttttgggttgagtattttggggacatttgacctttccagatcttgatgtctgtctctcaagatttgggaagttgtcagccattattttacgaaataagttttctatgccttttctacactcatttccttctataattcacaaaatgtgaatatttatttacttgatggtttcccatgtcatgtaggtttattcattcttttttaaatttttttttccttttgtctgggttatttttaaaaacctatcttcaagtactaaaattatcttctgcttgatctagtcgattgttgaagctttcaattgtatttttttaattttaatcattgaattcttgagttccgggatttctgtttagttgttttttatgacattctatttaatttctcatttagatcaccagttgttttttttttctgatttatgtatattttctatctgtgttcttttgtatctactaagttttaaaagattattatttaaatttgttaaggtatttcatagattttcttttggggctctgttattggagaattattgtgtttctatggcagtgtcatatttcctttttcatgtgtcttgcatccctacattgataactgtgtatatggttagcaatttcgtctttcagttttctggattagcttttttaggtaaacttttttctgtagacatatctatagtgtcatttgggtagagtgttttggctttggttcaggtggttgcattagtgtagtctctgtatggttactttggctgtaaataatgttaacagtgtctgcagtttccctagggcgttcaggtgaggttgttcatggagtcagcgacaagactttcctggcaacatggatatttggtgggcttgttctttggctcctaagggttgtgcacaggcactggcagtgttagcagtgggttgttcttgggctcctgggtggtgattggaggcacatggtggccttaccactggagttcatgaggtcatcatttgtggtacgcactaggtgggccagccctcaggcccgaagtctccctgtttacacattgactgtagttgtagcaggccctggttgagccagtctttgagttcacaggtggcacacatgggtgccttcatttttagatggatattttatcaaggtacaaacttttggattcaatttatctcaagtattttaaacatattgtcccattgtcttctggatttgatagtttctgttaaaaattcagctttaagttttcttgtttttcttttgaaagtgatatgtcttttttctccctctgactgttgttaaagtgttcttgttatctttgattttcagcattttgagtgttggttgtggtttttttcacctttgccagtgtggtgtttgccatacttcttaagtcagaacattaatatattgtatcagttttgggctagtctcagcaatttttaactttttctgaaagtattgtttctcctcactttctgtctgctttattctaactggaattatatttgtgttgaagtgtttaattcccacatatctcttatgctctgttcatttcatttctttcttgctgtgcttcagtgtggatatttcctgctgacctatattcaaattcactaatctgtgctttgctgtattcagtcagttataaaacccacccaccaactgcttaattgcagatagtgtgtttttcagatataaaatcactatttaatttttaaaatagattttcattctttgttgaagttttccttttttcatctactttgaagatcttttttaaagtccttgtcttctaactctatatcatctgtgggtctgtttatatttattctcttttcccttgattgttagtcacattttgtgcccctttccataccttgtaattttcatcatataccaaatattgtttataatagagcagcagaaattgaactaaatattatttttcttcaattctgtattagaaagataagatcaagtgctaatcacctcaactcaattatgaatcttactgcatcaagtctgggtggcagctttcgatacacttagaatgcctttgattttaaatgtcctaatgacaacaactgttgtgttgcagactcttctgtctggtgactttgtatttatatactgtaaaattgttggagattttactctacctttctggtcctgctccttttactcatttcctctggctccccacccactaaggggatgcttttggttgagagcaaatatcttgtgggaagacctattaaaattttatcctcacagtggtaggctacatctgttctagtgtgactttgtcttctaatcaccacaacattacagggattattatttgccccatggcctgttctcccaactgctgccccaaatcctcttaggtaattctggcactcagcaaatttttcagggagaaaactgtctgtaattttggacttcatcagattccagtttttcatgccagcttacaaattatcaagagctgtgctgttttttcttttccttagtagtgtccttctttcttagctagtctgtctaactggcaaatccttccagaaattaaaataatcagcaggattagctgacttaagagatattaatcatcctgcaaatttagtttctcctttctatttcccttgctcgccaatatttttaaaaatatgattttgtagtttgtctctttttttcctagttgttgtgggggcagtgacttgctactgtgtactagtaaattaatcttgtaacagtaagaacaacatttagaccgacatgtttattattttatgtaatgtatttatatagagttggtgtgcttaaagtagtggattgttattgaaatgttggcttgtttagaatattaatatttgttgctaaattcaccaggcctataaataaatcaatagtaatgtttggggaaaaatgaaaaaaaaaaagctatttttcatttcaaaatgtcttttggtcagcaatagcttaaatgaaatgtagacaaaaattaatttttttttcttttccccatttctatttagtgagtgatagttgcttcaggaatcttgcagaagaccgcagtgggataaatctcaaagatctcgtacaagatccttctttgtgagtattgtgctttcagtattaagtataaattaaaactttattattagtgttccttttctcaaaagagttttatgtgaaaacttatttaaggtacaacaattttttcttttctaataatgcgttttacacatattgaagtctgacagaacagttcagaaatagaatagattttagaaggaatgatgtcatgattaatgattgattttcaaggaggaatcctgatggctgatgatatcttgccaatgtggcagtagctactagccaagaaagatgattagtagttgatttccttgggaaagagagattgaatttgtttacaacaatttgaagttttttgaatatattgtttatagtaattatttgtaattataattagaaatataaagtagttatttgttataacaatatacatttgaatatgttagatatatttctgatgttttacatatggcacaagaattttggagagtttgatagatttcagtttttaatttttttgctcatcagtcagtcccattctttattggcatatctttctaatacatatactctacaataatgtcactttctatttcataaattttttttacacttttatatttactggtaaatatgcatactatctatgaacataccttcccaataagatcactgtttattaaaaaaaaataattaaaactagttaagcctgcgaagcagagtaaagaaaattgaatactgccaggtgccttctataatgatacatataatgcatacaattaaatatgtcctaataggaaattcatctcccagatcacatgtaatataccctcccacgggagtcactaataagtcattgagaattttgtgaggaataaacacaagaatatcttgaacttgaagattattgattctttaatgattgactagtcatgttaaaaaatatgagagtgctgaaaatgtatcgaatattgaagtttatatatgatgtcgtgagttcagaatgcatttccaagtctacctctctccatttttttcttttctccatctttctttttctaactcaaaaggattgcaaatattcctcctccttgatttttatccctactatgaagattgacagttgtcctttgagtcctgtgaaaatttaaccaacaatgtaattattctgttaggatgtaaatatacctagtgaataacatttaattgcattaagagttctactatccttatggatatgggtggaaactttacaatttcctcaaaagactttgcttatttgaatgaataaaataaattactggccaggcgtggtggctcatgcctgtaatcccagaactttgggaggctgaggtgggtagatcacaaggtcaggagatcaagaccatcctggccaacatggtgaaaccccgtccctacaaaaaatacaaaaattagctaggcgtggtggcatgtgcctgtagtcccagctacttgggaggctgaggcaggagaatctctcgaacccgggtggcggaggtttcagtgagctgagattgcaccactgcactccagcctgggcgacagagcgaggctccatctcaaaaaaaaaattattattgtattatttgtaagatatgttttagtaaaataagaatgtatgtctgtttaatgcagcaatatgatgaaaatatttgctcatatgaactccaattatataaaagatttgaagaactacacttgaataatggattataataatcaattgccatgttttggaaaaacttgttgcttcttcctggaatgtagaataacattcatcatttaacctaccactaaattctatatttaattttagtattctaaaaaaaaaattcatctcagactacttcattggaaggacaaaataattctcagtgtacctgtcttaaaacagccggaaatatcttaatatagcatcattctcctaacctgccattatcctcttggattagtctagtatgtaagaatgtcagcattcatggagaaagagtttgtttttactcctgcctgcttggctttctaaggaattttttctttattaagaactgtcaggatatactattgatgacttgaattcatattttaaagatatatttctcattaggtaaaatcttttagagaaagaaatgcccaatgtggaaatatatatatatatatatatatatatatatatatatatatatatatatatgttcatatatatatgttcatatatatatatgttcatatatatatattcatattcttgtgttgttatgatgggaaatattttattctgagttcctgtctgattgcagtattcatttagtatgtacattgtaggtgagtattttttttttttaagctaggtgcctcttttctgtctcagactcttggcataaatgttcactacttttcattgattcaggtatactagatggtcctacaaggagttgaattgttaatggtgcaacattgaataggaagtatatcagaaattttttttgtgtttttacaaaaatctcttcggccaggcacagtttctcacgcctgtaatcccagcactttgggaggccgaggtgggcggatcatgaggtcaggagatcgagaccatcctggctaacacggtgaaaccccgtctccactaaaagtacaaaaaattagccaggcgtggtggcgggcacctgtagtcccagctactcaggaggccaaggcaggagaatggcatgaacccagaggcagagcttgcagtgagcagagatcgccccaccacactccagcgtgggcaacagagcaagactccgtctcaaaaaaaaaaaaaaactcctcctcaaaaaatcactgtcatttgataactactccagactagtctgatggttattaaaattgtatacatgtcattttaatacatgttccaaataaaaattattagaataagatgtgtgttgagtgaatgctatgtatgttgatgtgcctggcagatttttattatgactcacccatttgagctgctgatactgaaaggagttgatggtaaataagaattaagaattttagcctcaatactgttagaaaggaagacagaataatagagcaagaaaaattaggctaaggaaaacccaggcttatctagtcaatattgatactcagagtagtgtattatatgtcttaattggataaatgagcagatacagaatttctgtggacaaagtacagaaataaaactgtaatgagttttattaagaatatatgatataaaacaatgtttaaaccaagagtagtcagagctagatgaggggcttactgcatcagagattgaaagtgcagaacctaaactgactaattcatactctgaatctgtgtcaagctaatggaacaatgataggtactctgtaatttactttaactgtatagtacatactccagtattttactgccattgtagtaaaacttgttactgggcttgaatgaaccaagtgagctattgtgtgaacatggcagagagatgccatgggagaaaaaaattttgagaaagttatgaatctctaagcaagactttctggtcttgctactaacttttcttttttttttttcttcttatactttaagttctagggtgcatgtgcacaaagtgcagatttgttacatatgtgtacatgtgccatgttggtgtgctgcactcattaactcgtcatttacattaggtatatctcctaatgctgtccctcccctctcaccccaccccacaacaggccccagtgtgtgatgttcccttcctgtgtccaagtgttctcattgttcaattcccacctatgagtgagaacatgcggtgtttgtttttttgtacttgggatggtttgctgagaatgatggtttccaacttcattcatgtccctacaaaggacgtgaactcatccttttttatggctgcatagtattccatggtgtatatgtaccacattttcttaatccagtctatcattgatggacatttgggttggttccaagtctttgctattgtgaatagtgccgcaataaacatatgtgtgccatgtgtctttatagcagcatgacttataatcctttgggtatatacccagtaatgggatggctgggtcacatggtatttctagttctagatccctgaggaatcgccacactgtcttccacaacagttgaactagtttacagtcccaccaacagtgtaaaagtgttcctatttctccacatcctctccagcacctgttatttcctgactttttaatgattgccattctaactggtgtgagatggtatctcattgtggttttgatttgcatttctctgatggccagtgatgatgagcattttttcatgtatctatttgctgcataaatgtcttcttctgagaagtgtctgttcatatccttcacccactttttgatggggttgtttttttcttgtaaatttgtttgagtgctttgtagattctggatattagccctttgtcagatgagtagattgcaaaaattttctcccattctgtaggttgcctgttcactctgatggtagtttcttttgctgtgcagaagctctttagtttaattagatcccatttgtcaattttgcttatgttgccattgcttttggtgttttagacatgaagtccttgcccatgcctatgtcctgaatggtattgcctaggttttcttctagggtttttatggttttaggtctaacatgtaagtctttaatccatcttgaattaatttttgtataaggtgtaaggaacggatccagtttcagctttctacatttggctagccagttttcccagcaccatttattaaatagggaatcctttccccattgcttgtttttgtcaggtttgtcaaagatcagatggttgtagatgtgtggcattatttctgagggctctgttctgttccagtggtctatatctctgttttgataccagtaccatgctggtttggttactgtagccttgtagtatagtttgaagtcaggtagcatgatgcctccagctttgttcttttggcttaggattgacttggcaatgtgggctcttttttggttccatatgaactttaaagtagttatttccaattctgtgaagaaagtcatggtagcttgatagggatggcattgaatctataaattaccttgggcagtatggccattttcatgatattgattcttcctatccatgagcatggaataaatgttcttccatttgtttatgttctcttttattttgttgagcagtggtttgtagttctccttgaagaggtccttcacatcccttgtaagttggattcctaggtattttattctctttgtagcaattgtgaatgggagttcactcatgatttggctctctatttgtctgttattggtgtataagaatgcttgtgatttttgcacattgattttatgtcctgagactttgctgaatttgcttaccagcttaaggagaatttggactgagacggtggggttttctaaatacacaatcatgtcatgtgcaaacagggacaatttgagttcttcttttcctaattgaataccctttatttctttctcctgcctgattgccctggccagaacttccaacattatgttgaataggagtggtgagagagggcatccctgtcttgtgccagtttttaaagagaatgcttccagtttttgcccattcagtatgatattggctgtgggtttgtcataaatagctattattgttttgagatacgtcccatcaatacctaatttgttgagagtttttagcatgaggggcagttgaattttgccaaaggccttttctgcatctattgagatgatcatgtggtttttgtctttggttctgtttatatgctggattacgtttattgatttgcgtatgttgaaccagccttgtatcccagggatgaagcccacttgatcatgttggataagctttttgatgtgctgctggactcccacacaataataatgggagactctaacaccccactgtcaacattggacagatcaacgagacagaaagttaacaaagatatccaggaattgaactcagctctgcaccaagaagacctaatagacatctacagaactctccaccccagctttgttctttttgctcaggattgctttggctattcagggtcttttatggtttcataccaattttaggattattttttctatttttgtgatgaatgtcattggtattttgatagagattgcgttgaatctatagatcactgttggtagcatgttcatttttacaatattacttctttttctttattttatttggtttttttttttttttttttgagacggagtttcgctcttgttgctcaggctggagtgcaatggcacaatctcggctcaccgcaacctctcgcctcctgggttcaagcggttctcctgcctcagcctcttgagtagctgggattacaggcatgtgccaccatgcccggctaattttgtgtttttagtagagacagggtttctccatgttgttcaggctggtctctaactcctgacctcaggtgatccgcccacctcggcctcccaaagtgctgggattacaggcatgagccactgtgcctggccaatattatttctttcaattcataaacataggatgtgtttccatttgtttgtgtcctcttcaatttctttcatcagttttttagcttgtttgtgtagagatctttcacccacttggttaaatttatttctaggtacagttgatccttgaacagtatgagtatttggtgtattgctcctgcatgctgttgaacatttaggtgtaacttttgacttgccaaaaacttaattactaactaataagctactgttgactggaatccttaacaatgacataaacagttgactaacacatattttacatacgtattacatactgtattcttgaaataaagtaaactagagaaaagaaagtattattaagaataacaaaattaagaaaaagaaaaatatttactattcactaagtcaaagtagatcaagatataagtctttatgcttttcatcttcacattgaataggctgatgaggaggcggaggaagaggaaaaggagttggttttgctgtctcaggagtggcagaggcagagaagagttgtcagggaggtagaagaggcaggcacactcaagtgtaacatttatggaaaaaagtctgcatgcatgtaagtagacccatgcagttcaagtctgtattgttcaagggtctaactgaattttatttttgtatgtagctgccataaaatggattgctttttcagtttctttttccactagtttattgctgatgtttagaaatggtacttattttttaccttgattttctgtcctgcaaaagtactcaacttgttcatcagttctaagagtctttgaggggagtctttactgttttctatatgtcgtctacaacatgggagatgaacgggaacaaatttggatagtcctttccaatttggatgccctttaattctttctcttgcctaattgttatgactgggacttccagtactgtgttgaatgaaagttgtgaaagtcctttgcagggacatggatgaagctggaaaccatcattatcagcaaaatatcacaaggacagaaaaccaaacaccgcatgttctcactcataagtgggagtttaacaatgagaacacatggacgcagggagtggaacatcacacaccggggcctgtcggggggtggggggctgggggagggatagcattagtaaaaatacttaatgtaaatgaccagttgatgggtgcagcaaaccaacatggcacatgtatacctgtgtaacacacctgcatattgtgcacatgtaccctagaacttaaagtataattttttaaaaaaagaaaaagaaagtggtaaaagtgagcatcttttttttgttccagaacttagaggaaaagcttttaacttttcccaagtcagtgtgatgttggctgtgggtttactgtatatggcttttgttgtgttgaagtacattccttctgtatctaacttggtgagagtttttatcaggaagggatgttgaattttattacatgctttttctatgtttattgaaatgattatattgtttttgtccttcattccattgatgtgatgtgtcatatttattgatttgcatatgctaaaccatcccatttatctcacccatttatgcctgggataaatcctacttgatgatggtgaattatctttttaatatgctgctggattctgtttgctagtatgtggttggtaatttttgcttctatgttcatcagggatgttggtctgtagtttttgcatttgagtccttggtctagttttagtatcagggtaatgctggcctcttagaatgagttttgaagaattgcctccttctcaattttctggaagttttagacatattgattttaattctgctttaaatgtttgatagaattcaacagtgaagccatagggtcccaggcttttttaaaattacaaatttagtcacgttaattttcaattggtttgttggggtttttcatttcttcttggctcagttgtggtaggttgtttgtgtccaggaccatttctgctaggttttctaatttgttggcgtatagttgttcataatagtctttaatgatttttatttatgtggtatcaattttttgtgtcatttttccattctgattttatttatttgagtctttttttatcttggtttatttgggtcttttctctttttgtcttcgttggtctagctagtagtttggcaattttattgatcttttcataaaaccaactttttgactttttttatatgttgtatttttttctcaattttacttatttcagcttggatattttttattttttctactaattcttacagtttgttcttgattttcttgttccttaagttagcttgttaggctatttgaaaattttctacttaatgttgaggtttattgctataaacttctctcttactatagtttgtgatgtatctcatattttttggtatgttgtgtttctcttttcatttgtttcaagaaatttgaaatttttttcttaatttttttattgacccacgttcattgtagaacatgttcttcaatttccctatattctcacagtttcagtagttccttttgttgatttctagttttatttaattttggccagaaaagatacttaatatgacttcaattcttttagatttgttgagccttgttttgtgacctaatatgtggtctgttctggagaatattccatgtgctgatgaaaagtatgtgtattctgctgcatttgggtgatattttctctaaaggtttgttaggttcatttggtctgaagaacagtttaaattaaatgacctctgtcacatgttgagagtggagtgttgaagtccccatctattattgtatcagaatttattccttcctttaaatctaacaatatttgcttcatatatctgggtgctccaatgttgggtgcatattatatttacatttgttatctcctttactgaattaatatctttatcattatgtaatgaccttctttgtttctttttagttgttttttgtttttatgtttgtttgagacacagcctcactccctcggtttgtgtaagtacactctatgaaggtcacataaggttgaaataacctgaggatgcatttctcagaatgtatccctgtggttcagtgacatttgactgtaatgagtggcaaagcagtaaaccttggtctgtattattcgaactcctatatgctgactcacttacgtatttcagtgaaaacccaaagatttttatttagtgttgaaggcctaaacctcatttaaaattaagtataggctgggtacagtggctcacacctataatcctggcactttgggagactgaggtgggaggatcagttgagcccagtaatttgagaccaggctaggcaacatagtgagacactgtctctacaatttttattttttttttttatttttagatggagtctcactctgtcaccaggctgaagtgcagtggcgcaatctcggctcactgcaacgaccgcctcctgggttcaagcgattctcctgcctcagcctcccgagtagctgggattacaggcactccccaccacacccagctaatttttgtattttcggtagagacaaggtttcaccgtgatggccaggatggtctcgatctcctgaccctgtgattcacctgccttggcctcccaaagtgctgggattacaggtgtgagccactgcacctgacccatgaacatttttaagtgattaaaaaaaatttttaatgaatattttatagtacatgaaaattatatttcagtgtctataaatagttttgttagggaacacagccatgcatagtgtttacctactattcatggctgcttttgaattataatagcagagatgataagttgtaacaaggatcatttggcccactaagctgaaaatgtttattatccagtcgtttacagaaaacgttgctgacaatcagatatagaggatagactacaaagtgagctaaataatttatcagtattctgttcaagatagtgtacactgggagattttcagaactttctctgattgacatagaatggaagccaaaattaagatatagggtctgcagaaaacaaaactaaacaaacaatagcaaaaactatccagtactttggttagcaacctctaatccaaaaaagataataaaagctagatagcatttttctttttctatgtttgacaataaaatcaaattcggatttgtccataaaactcctgaaattctatgcaaaatatatttgtgagcaaatgtttgtttttctggggcgaaagtccttagttttcctttgattttctgtgggttttgcagatgcaaataggttaaggattactaatatatatagttaactcccaaataaagaggtttgaatatatctttactttacctgctaaccttcttatagtcctgggtgctttctgttatttacctcctgactgtaaaacatgcaatttttattactattttctgacacacttcattgtcatatgctctggtcattaggtataagtttacatggaaggagtgaggagtatgatgaggtactaacatttatcaactacctgctaggaactaaacaggtgctttatgcctagtttttaatatgatgtttcataattctgttagacatgctgagtaatttgaaattcagagaagttaaatatctgcagatacactatctgtagattctctagtagtaggcctgggactccaacctacgtctctctaataagtcctaaattatcctggctcctctatacaaccaggagagagaacacagaaagcaagtggggaacacagatgtctacctttttttcttatcgaacagttttctataatatttgctatttctaattaccatttttatatgaccattggtgcatataaactatatgacattttggtctctatgagcattaaaaggataaagacattgtattagattgcttgaattgaatggcttgtattgttgttatgaaataccaaagaaatctttataatatttggaattaaaatattaccaaggaagtaaccctgaactgaagcttatatagagcacttgtttgaattatagtgttatattttttatgtttattcatactaggtagtaattctctaaccttatgatttcatagcttcattgcactttaaaaaattataagcatggcattgaactattgtttatgtgggtaacatctattgatatttactatgttaaagaataaaattatttaattcacataaaatataaataagcccactacatattaaaataaataatataatgaaaaatagctgtatatttcaaaactcccaaaatagtcaaaatattaacagtttttttacattttataaatctctataatctctggcttaataaaagatagctaaattttcaaataactgtttctacgtttaatctgttgtaatatgtttttgttgaaatttgtgaggaaaattatgcttggaacaattatgtaacttggaaggaatattttaataactttttctaatgaatatggatattatttgttttgctattttactcaaactggacaataatgatagacagtttcttaaaggtaagtgtagtagtcagagttctccaagaaacagaaccaatgattgattgattgatagatagataggtagatacatacatacatatatacatacgggatttattaggagaattgactcatgcagttatggaggctgaggactttcctgactggccatctgtaagctggaattctgatgtcttaggacaagagaaatttatatcccagctccagaagagagaggaaatagcctatttgctctatttcggtcccctctaattgggtaggtctgcccacattgagggcagatcttacttactcagcctatggactcacttgtgaatctcctctggaaacattctcacaagcatacacagaaataatgctttatcagtactctgtataatccttcaaccagtcaaggtggcaccaaaaattaatcatcataataagtaacattgtggaattcaaagccatattaaggacattttcataatactctgttaagttaaaatctattggtccaccagagtagccaatacaatattgaagaataagaaaaaagttggaggacttgacactatacagcttcaagatttattataaagctgtggtgataggggcagtgtagtattggcaaaatagacaaatagatcaaggaaaaagaatagagagcccagaaatagacccatataaatatagttgctgtggtctgaatgtatatatctgcccagaattcatatgttgaagcttaacccccgatgtgagggcgtttgaaggatgaggcctttgggaggtgatttagtcatgagggcagagacctcatgaattggattagtgtccctaataaaagaggcctgagacaggcccctttcccctaccaccatatgcgattatagccagaagacagacatctatcaatcaggaagtaggccttcacctgaatttcttggcaccttgatcttggacttccagacctgcagaacagtgagaaataaacttcttttgtttatcagccacccagtccatggtattttttaaatagcagctcaaatagacttaagacaatgttcaactggtctttgaaaaaggaataaacaaaatacaatggagcaaagatagtttttttaacaaatggtgctggaacacctggacatctgcatgctttaaaaaattgaatctggacgtagaccttacacccttaaaaaagttaattcaaagtggatcataggactacatataaaacacaaaactataaaactgccagacaataatataggagaaagcctaggtaaccttgggtatggcagtgattttcagctctaaaggtaccatccacaaaagaaaatattggtaagctgggcttcattaaaaactctgctctacaaacacaatgccatgaaatgaaaagagaagccacagactgggagaaatattttcaaaagacgcatctgataatgtactattacttaaaaatatacaagaactcctaaaactcagcaataagaaaatgaacaaccctaggccgagcgcagtggctcacgcctgtaatcccaacactttgggaggccaaggcaggtggatcacttaaggtcaggagttcatgaccaagcctggccaacttggtgaaaccccatctctaccaaaaatacaaaaattagccatgcgcggtggtgcacgactgtaatcccaactactcaggaggctgaggcaggagaatggcttgaacccaggaggcggaggtttcagtgagccgagaacatgccacactgcactgcagcctgggcaacagagcaagactctgtcttaaaaaaataaataaataaaaataaaaataaaaataaactctattgaaaagtgggccaaagaccttaacaaacacctcaccaaagaagatatacagatgtcaaataagtatataaaaagatgttctacattttatgtcatcatggaaatgcaaattaaaacaacagtgaaatattactacatatctattagaatggtcataatctggaatactgacaataccaagtgctgatgaggatgtggggcaagaaactctcattaattgctggtgggaatgcaagatggcatagccactttggaggacagttcagtggttttttaacatgcattccagcagttttgccccttggtatttatccaaatgtgttgaaaatgtacatccacacaaaaatctgcacatagatttttatagaaactttataaatgacaaaacttggaagcaaccaagataaccttcagtgggtgaatggataagtaaactgtggtacatccagataatggaatattattcagtgccaaaaagaaatgagctatcaaactatgagaagataagaaggaaacttaaatgcatattactacatcaaagcagccaatctgcaaaagctacacattgtaagtatccagctatatgactttctggaaaaggcaaaactatgaagatagtaaaagaatcagtgcttgccagaggttagagaggaggaagggatgagcaggcagagtacagaggatttttagggcagtaaaactactctgaatgatactacaatgaaggaaacatgttatgatgcattgtctaaaccatagaatatacaacactgaaaatgaaccctaatgtaaactgtggactttgggtgataatgatgtgtcagtggaggtttatcagtggtaataaatgtgccacttcgttggggtatgttgataatgggagaagctatgcatattgcagtacaagggatatatgggaaattatatggaaaaatttctcacttcctaaagatgctatgaatttctttttcctttaaagaagtttatgcagatttgtggttatctcataaacaaaattaaccataaaagagtaatcctcattagaaaaatatttaagtcacgtttttaaagtctgctcaattttgctgtaaacctgaaactaatctaaaaatgtaaagttttgttttactatccattagccttgagtcttccaattctggaaagatggagtaaatgtactttggtctattcctcatgctaagtacaactgaaagtcctaagaaataatgtggtggtgtgttcttgtttttgtgtgtgtgcctcatatattttatacttggagctgaagcagctgacaacctagaaatatcgaaagacactgacaaatagcttcaacaaaagctttctctgtttagccaaagggcgtagaaaccataccaagtcagaaagcttatactataaccaccctactcctgccaaacactacagaaaaactgtggtcctacaccaacccatgccagcaaaagttgagtggggagcctggattctcaccctcactagactgtgatgaagtaccccaatttgtggtcccctgaaagggtctcagaacctctggtattcaagatcacagctttgagactttaagctttactactaaatgagttaaatttctcacttcctaaagatgctatgaatttattttgtttttccttttaagaaatgtatgtagatttgtggtttatcacgtaaaattaaccataaaagagtagtcctcattagaaaaatatttaagtcactttttaaaaaagtctgaatagttgaagtttatttttcaccaagtgataatttatttttgtcaattttgtgggaaagtaatgacttattatctgtttataaacaaaatttctacacactaatattttacatttgaatacatgtgtaaatttctttactcctatatttgtccctcacaggaatccacatcttcacctcatcttttaataagtattagtatgttttgttgactactgaggcattttatagttaatctacttaaatattagttggatttataccaaaaagttatctaaaataatattgtcaatgatgaattgtattaaacaaatgtgtttgactactctgtaattcagcatttataatttgccttagttatgtagtacgttgtgtgacttcacagtatcaggttttgtgaacttctgtaagcatcctttctgagaaagccaatgggaaaagtataattttttactacttgtaattttggataattgttgtatataagaatgtttactattaaaggcacaagatgaaatgtagactcaacagtattgaatgatgttaagaacaaattagattggagatactggtgtagtgtttttctctggcttctgtcatgtgaactttcattcttatattggatagatggtggatatttaaaagtatggtctaatctaggggttggcaaactatgatccacaggtcaaatctggcctgctacttgccttttttttttttcttttttcttttttcttttcttttttttttgagatgaggtctacctctttcactcaggctggagtgcagtggtgcaatcatggcttactgctgcttctgcctcccaggttccagtgatcatctcacttcagcttcccaagtagctgggactacaggcatgtgccaccacagctggctactttttacaattattatttattgtagagagaggatctctccatgttgcccaggctggtctcaaactcctgggcataagagatcctcctgcctcagcctcccaaagtgctgggaatgagccactgtgcccagcctgctgcctggttttataaataatattttcatcttatgaaattgaaaaatatgacccattcgaaagcactttggaaattgtgaaataaatatttattaaatgactaatttcaagtatcacaaatagttatttaaataataatacattatacagaaaatatatggattttgcctgaaatttcatcacaagttaaaaaatacattttgaaaagggatatgatgaattttgttaatgttagtctttaaactgagtcattctgcttgagcatttcaaaatggagaaaaaggttaaatacttgctgaataagatttgtcctctgatttgcttctggtctgtcactattttgtagataacttgaaatctgtgtgaaattacagaattcataggtaaaaaggggatgtaatattttttggagaaaattgaactatatgttcagtgaatgtaaactcttcttactgatgttgtcatactcttttaaaagtagcagatacctgggactaattattcaggatttattctgaatcagggaaatccagtgcttatgtttactcaataaaactgctattttaaaagaaatatttttatctttggaaagacaatgatacatgaaaattgaagttttgttagaacacagtcttactcattcacctatgtattacctatgggtggtttcactgtacaacagcagagttgagtagtttcatatgtcactcaaagccagaaatacagtcatccatcctttggtatgtgttggggattgttccaggacctctgcatataccaaaatctgcatatactcagtccctccattcggctctggggaacctgcatgtatacaaaacattggccctccatatatgcgggttttgcatttcattaatttgatctatgtttggttgaaaaaaatctgcagataagtggaaccaaggagttcaaacttgtgttgttcaagggtaaactgcattttgactgtctttacagaaaaagtttattgacccgtggtgtagataagaaatcattgtgacctgagtgagaatattagtcaatgtaactcttcaaggtaatgaaaagagtactgagctatgatttaaacttaactgcagagaagtctagcatattccagttatcagcagtgtagcatgataactaaattacttgacctttcagaatcttagttttctcaattgttaaatgaacatactgatactattctactcacttcacagtcttaaaagggatagcattaggagatatatctaatgctaaatgatgagttaatgggtgcagcacaccaacatggcacatgtatacatatgtaacaaacctgcacattgtgcacatgtaccctaaaacttaaagtataataataattaaaataaataaataaaagaaaataatttaaaaataataaaaggtaagtgatgataatattatattaaatatggtgatagaattgctggataatttaatcagggaatgctaaaaagatagtgactcgatgttgataatttcataagcttttcattatgtctttgtgagtatatagttcattagaattgttataagaagttgttgttgaataatttcaggtcaatgtggaagatgtctggtattttaaagtattctgttttagaacaaaatccagctttttaatagcgcatgcaagaccagtaatgatctgattacttcctggctcttcaacttcacctctcactatttgctgtttttatactatttgtataaatgatggaattagagagagaaaggctaagataataggagtgaaagaaacatctatgccagacagaagtaaactatggctgtgtttgccatgatttgtttttacaatctggttgtttacagaaacaaagcaacaaaaactaaatatgaaattaaataatgaagaagctatgccgaaggatgtttaaaatttgaaaaaacaactttataagaacctttatgttttcttatgactggataactactatttttttaaactaatcttaattttagagactataaaaggagagagattacatataggaacttttccttttggaaacaattaaaattgtgtgtcttatacgggctattcaacatgatataaatgtggaaaatctacttacagaaaaatttctgaggttatagtgttaaatgttttctatttctgtagaggatattcaaagaaaaattggtatcagtaaaatggacaactgcacaaaaccctatttgtttttaggggaggaggtgagagattgaggtgggactatacattttcaaagagagaggcacttagctactagaaatttaacgaatattttatttttgacacacatactggaatttctaaactgtgtgagagaagtaaaataattttacagttaaaattatatgaaagaagtagatttgtgatttagatttagagggaaaacctaacagtaatacatgtacgcatgttggctgttgctgttttgaatttatttctcccttatgatctaatttaaatttgtatttttttacttagtaaattattggtctgggacaactcggggatgaaggattttacttaatttttctaaattagcacttctgctattgtctttgcatttattattcatcctagaatagaacaaatatccagttaaaaatctttattatgaccggatgcagtggctcactcctgtaatcccagcaccttgggggccgaggcgggtggatcatgaggtcaagagatcgagaccatcctggccaacatggtgaaaccccgtctctactaaaaatacaaaaattagctgggcgtggtggcgtgcgcctatagtcccagctacttgggaagctgaggcaggagaatcgcttgaatccggagacaggggttgcagtgagccaagattgcaccactgcactccagcctggcaacagagcaagacaccatctaaaaaaaaaaactatattatttctcaattatttttatttcagttatatcacaactatttgaaatttgcttatgaagctaccaaagagtacatgcacagaaaggaaaccttatgcttgccctgccctgccatccagttttccttccctaaaagcaacctctgttacagaggttatctgtgcatgcgcacatgtgcacacacacaaatgtgaatgtacagatacatatatacatatgtatatatgcatatttacatatgcatgtaagtgcaatatgtacatattacacatttgaataaaaatacatcttacaaaaatgtatactgttgtgcatatttctcttttttttacaatatctcaaatatgtttcatatctaaacagacatcactttttaatagctgcatagcatcttgtttatttataactaatacataataactgtacatttgggtgcggccatgatggctgactagaaacagtagcaattggatgctcccatcaaaaagaaccataataagtgtgtgaaaccttcacctgcaaccaaggtattcaggctgtctaatcagaaatgactaggtggctggtgtgatccacggagagaaaggaagagcaatgtggtgtggcagcccacttgggagccacacagggcagggtagcccctaccccgcagccaagggaagacagtgagtgagcctgctaaccagctggggaaactgctttttccacggaactgtgccacccatggatcagaagatcacactcgtgaacctacgctaccagggcctaacatttcaaccccagagccatgtagattctcaacagcctctcagctagaatctacttaagcctaccaagctcctggggggaggggcgaccaacaccacagctatggctgcctactgtctaagccatttgagatccttggggtaggggcagcagccagcactgagactcacgactgcctagcatgctaagctccctgggcgggggaagggtggcatccatctctatagctccaggctgtacttctcccctcctggagccagggaggctggacagcttggtcccaagacatgtcctccacagcccaacacaccagctgtggcagactgcggccacagtgcctcttcaggtgtgaccatgactcatccttcctcactgggtggggcttccctgcaggaactccaaaaactccagccagaggctcagggacagaacccagatctccctgggcttgaacccctaggggaaggagtcgccacagtctctgtggaccagcagactttgcctttcctcctggtagttttggggaatccaggcagcccagacgagtgggttttcccccagtgaagcacagcccttcccccaagggacaatctaagtacttcattaaacaggtcctgttccctgtgccacccaactgggtgagaccctccaaaagggattgtcaaaaaccctatacaggagcgatcctactggcatcagattggtgtcccttgagatcagagatcccagaagaaggagcaggcacccatctttgctgttctccagcctccttgagacatctccagatgtgagagcgaaccaaatgaatagggcctgaagtgaacccccagcaaaccacagcagccatatagaagagggacctgaccattgaaaaacaattaaagagaaaacaacaacaacagcatcgacaacaacaacaaaaagccgtcatgaaaaccccatccaagggtcagcatcctcaaagattgaaattagacaaactcatgaagatgagaaagaatcaatgaaaaaatgctgaaaacccaaaaggccagagtgcatcttctccaaatgattataacaacagcaaggaacctgatagaggatgagatggacaaactaacaggagtagtcttcagaagatgggtaataaaaaactacatggagctaaaggagcatgttctaacccaatgcaacaaagataagaacgttgataaaaggttagaggagctgccaactagaataaccaatttagaaaggagcataaatgaccctatggagctaaaaaacacagcatgagaacttcatgaagcatacacaagaatcaatagccgaatcgaccaagtggaagaagggatatcagtttgaagaccacgttgctgaaataaggcatgcagacaagagtagagataaaagaatgaaaaggaatgaacaaaacctccaagaaatatgggacttcagcgtttaaaaagaccaaatctatgattaactggaatacctgaaggagatggggagaacagaaagaagctggaaaacacacttcaggataatatccaggagaacctccccaacttaacaagacaggccaacatgcaaattcaggaaatacagagaacaccactaagatactccacaagatcaacccaaagacacataatcatcagattctccaaggacaaaatgaaggaaaaagtattaaggacagccagagagaaaggccaggtcacctacaaaggaagcccgttggaataatagcgtaactctcagcagaaaccctacaagccagaagagattgggggccaatattcaacattcttaaagaaaataattttaaacgcagaatttcatatctagccaaactaaacttcataagcaaaggagatcctttccagagaagcaaatgctgagggattttgttaccaccaggactgccttgcaagagctcctgaaagaagcactaaatacggaaaggaaaaaccggtatcagccactgcacaaacactccaaaatgtaaggaccaatgacactatcaagaaactgcatcaactagtgtgcaaaataaccaggtagcatcatgatgacaggatcaaattcacacataataatactgaccttaaatgtaaatgggctaaatgccccaattaaaaacacagattggcaaattaataaattttcaagacctattggtgtgctgtattcaggaggcctatctcaagtgcaaagacccacataggttcaaaataaaaggatggaggaaaatacaccaagcaaatggaaagccaaaaaaaaaaagaaagaaagaaaaaaagaaaaaaaaaagggcaggagttgcaatcctagactctgacaaaacagagtttaaaccaacaaagatcaaaaaaagacaaagaagggcattacataatggtaaagggaccaattcaacaagaagagctgactattctaaatatatatgcacccaatacaggtgcactcagatttattaaacaagttgctagagacctgaaaaaaacttagactcgcacacaataatagtgggagactttaacaccccactgtcaatattagatcaacaagagagaaaattaacaaggatgttcaggacttgaactcatatctggatcaaatggacctaatagacatctacagaattctccaccctaaatcaacagaatatacgttcatctcggtgccgcatagcacttattctaaaatcagccacataattggaagtaaaacgctcctcagcaaatgcaaaagaactgaaatcataacagtctctcacaccacaaggtaatcaagttagaactcaggattaagaaactcactcaaaaccacacaattgcatggaggttgaacaacctgctccagaatgactcctgggtaaataatgaaattaaggcagaattcaagatgttctttgaatccattgagaacaaagacacaacgtaccagaagctctggtacacagctaaagaagtgtgagagagagaaacttacggcactaaatgcccacatcagaaagctagaaaaatctcagatcgacaccctatcgtcacaatttaaaagagctagagacgcaagagcaaactaatccgaaagctagtagaagacaagaaataactaagatcagagcagaattgaaggagatagagacacaaaaacccctccaaaaaaatcagttaatccaggagctggtcatttgaaaagattaacacagtagatagactgctagccagactagtaaagaagaaaagagagaagaatcaaatagacacaataaaaaatgataaaggggatatcaccactgatccaacagagatacaaactaccattagagaatactataaacacctctaggcaaataaactagaaaatctagaagaaatggataaattcctggacatgtacaccctcccaagactaaaccaggaagaagttgaatccctgaattgaccaataacaagttctgaaattgaggcagcaattaatagcatactaaccaaaaaaagcccaggaccagatgaattcacagtggaattctaccagaagtacaaagaggagatggtaccattccttctgaaattattccaaacagttgaaaaggagggactcctccctaactcattcagtgaagccagcatcatcctgataccaaaaccgggaagagacacaacaaaaaaagaaaacttcaggccaatatccctgttgaacattgatgcaaaaatcatcgataaaatactggcaaaccaaatccagcagcacatcaaaaatgttatccaccattattaagttggcttcatccctgggatgcaaggctggttcaacatacccaaatcaatgaatgtaacccatcacataaacagaaccaaagacaaaacgcacataattatctgaatagatgcagaaaaggcctctgataaaagtcaaaatcccttcatattaaaaactctaaataaactatgtattgatggaacatatctcaaaataataagagctatttatgacagacccacagccaatagcatactgaatgggcaaaagctagaagcattctttttaaaaactggtacaagacaaggatgccctatctcaccacttctattcaagatagtattgtaagttctggccagggcaatcaggcaagagaaaaataaagtgtattcacataggaagagaggaagtcaaattgtctctgtttgcagacaatatgattttgtgtttagaaaatcccattgtctcagcctaaaaactctttaaattattaagcaacttcagcagagtctcaggatacaaatcaatgtgcaaaaatcacaagcatttttatacaccatcaatatacaagcaaagagccaaatcatgaataaactcccattcataatcgctacaaagaataaaatacctaggaatacagctaacaagggatgtgaaggacctcttcagggagaactacaaaccactgttcaaggaaataagagaggacacaaagaaatggaaaaacattccatgctcatggataggaagaaacaatatcgtgaaaatggtcatactacccaaagtaatgtatagattcaatgctgttcccatcaaactaccattgacattatttacagaattagaaaataactactttaaacttcatattgaatcaaggaagatcccatatagccaagacaatcctaaccaaaaagaacaaagctagagacatcatgctacctgacttcaaactatactacaaggctacaataatcaaaacagcatggtagtggtaccaaaacaggcatataggccaatgggatagaacagagacctcagaaataacaccacacatctgcaaccatctgatctttgacaaagctgaaaaaaacaagcaatggggaaaggactccctatttaataaatggtgctaggagaactgggtagccacatgcagaaaactgaaactcgaccctttccttacaccttattcaaaaattaactcaagatgtgttaaagacttaaatgtaaaacccaaaactataaaaaccctagaagaaaacctaggtaataccattcaggacacaggcatgggcaaagacttcttgacaaaaatgccaaaagcaattgcaacaaaacccaaaattgacaaatgggatctaattaaactaaagagcttctgcacagcaaaagaaactatcctcagagtgaacaggcaacctacagaatgggagaaaattttgcaatctacacatctgacaaaggtctaatatccagaattcataaggaatttaaacagatttaccagaaacatacaaccccatcaaaaagtgggcaaaggatattaacagacacttctcaaaagaagacatacatgcagccaacaaacatttgaaaaaaaaaaaaaacaacatcactgatcattagagaaatgcaaatcaaaaccacaatgagataccatctcacgccagtcagaatggcgattattaaaaagtcaataaacaatagatgctggtgaggctgtggagaaataggaatggttttacactgttggtgggaatgttaattagttcaaccattgtgaaagacagtatgtagatttctcaaggatctagaaccagaaataccatttgacacagcaattccattactgggtatatacccagaggaatataaatcattctactataaagacacatgcacgtgtttgtttattgcagcactcttgacaatagcaaagacatggaaccaacccaaatgcccgtcagtgatagattggataaagaaaatgtggtacatatgcaccatggaacactatgcagtcacaaacagagaatgcgatcatgtcctttgaagggacatgggtgaagctggaagtcatcatcctcagcaaacttaacgtgggaacagaaaaccaaacaccccatgttctcactcttaagtgggtgttgaacaatgagaacacatggacacacggaggagaacaacacacaccagggcctgttgggcggcggcagcgaggttagggaacttaaaggatgggtcaataggtgcagtaaatcactgtggcacatgtatacctatgtaacaaatgtgcacgttctgtataggtatcctagaacttaaaataatgtaattttaaaggtcaaaaaaccctgtacatttattttatacaaagtgatgtttcaatgtaggtatacattgtataatggtcaaatcaggcagttactatatctaacagtttaaacatttatcatttctgtgtggtgataatattcaaaatcctctcttctgcctatcttgaaatatacattgcattcttattagctatagtcaccctataaagtttcaaaagctggaggttttggtgctcaattgattgaacagtttgactaaagatttccaagtgaatttttaaaacatgcacccaagtttagatgatttattcataaaagtgctcagtatcattgcagggtacttatgttgatttaaaaaatagttcttcaaaggctcaagcaattttgctcatcttagtttagagacatctaaaaacttcaaaaaaaaaaatggcgagcttaacaaactgttaagtccctttcggcatatcttcttacatccttctttgccttccaacaattgtgaataataggactagaaagagaaaaatgagagaaaacctcataaggtattcaatctccatgcttccacaaatgttttggaaatatttggagacagttatgtattagttaaatattatctcaatatgtgctgtagctgaaaatcctgttatcagtataaaactttcttcctgtatttcacaagaattgagccacatttagaggcatccaccaaccattttctggacatgaatttacaagataaataactcccctttagggaaattaaatatttatatattttaagcatttcagtatttaacacaacatgataaggaaagaatataaaaagatttcaatctagagcagtaatttactgagtctgagagattgccagatttgcttggatttgccagatcctgttttagaagtatgccaaagtgtgaatattttatatttttaaatataaaataagtatttctagttacatagttttcacatgacatgctggactgtagattatatggttgcatgtttttcttccactaaacttgcatttagcagcaagtacggagctcaaaagtccctatcatcaatattttatattgtaaaactaattttagtagaatattaagcttttaaattattaaacatgtgaagaactcttaatagtctattatacataagtattaaaacataagagttcagaccagtctgggtatttagaaaaatgagtaatttaaaaaatggatccaaagatattaaaaagaagataatacagtattataatgtgtcaggagatattcaggttaaaataatcatatcttagataatttgccaatgagattaatataatgcctctttctgatgaccacgtttttgttagggcctttatttgaacagtgttcctacagctttcaataactaaaagattagcagccttttctaaacaaccattcttttaaacataaaatagcactattaaacaggattagaactctgtattagattgaaagcaccctgaaatgaagagccccatctatcacattaagcctgtactgtagtccccttttatccacaggggataaattccaaaactgccagtgaatggctgaaaccacagatactactgaacccaagtactgcgataccacaatagctgatctgataacccagatggctggtaagtgaataacaagtgggtagcctatacaatgtgaattcactggacaaagggatgattcatgtcccagtgggatggagtgggaaggtgtaaaatttcatcatactcctcagactggcacataatttaaaacctaagtattatttatgtctggaagtctttatttaatatttcagatcacagttgaccttggaaagcaaaactgaagataaggaaagactactctattctcattgctgggcaaagtccctcatacttagtaagtgatgtctttccttaatgaagtcacagacctaattttatgttttagcccttccacttataagatatacatccaaaaaaaggacaaagcactccaaaggggaaatgtatctttttgtcaagtcagggaatacttagtaaggagaagacaatttgagttatcagtgtcaagagagaagttggattgcaggaacaaagttgatgccattaaaaaaaaaaaagaatagaagttgtttgtgaaataatgagtgtccactgcattagttatatgaagggaagtaatggaaagctatgttggagggaggggaattttttagccagaaaagcacatttgtagttgtacttataaagatgattaacagtagtgcttataaaatggactggatcagagatcctttatacaactgtaaatgctttatatattatttctataaatcaccctgggttcttagttattcatattttaaaagttcattgataactgtatattaagatgctaaaataatagaattgcttttgcaaatacaaatatatgccaaatagattccagttatcaatcatttggtaatttactcctctgtttataaatttcaaaatatgttccaaggcgtggaatctgagaattcttttttccaaaacattgtacatattatatgagctgtgttaaagtgaatctaatcttagtctatgcatcatcatatttcagaagctgttacccaggtcgtgatatgtcttttttcacatacatgtgaatatgaaaatagcactatatgtataaaatttctttttatggtaactcacaaatattatttctctgcatgtttattttatactgttttattttttctgtagccaacttcattagatctgcttgtttgccctcaggtagaacatctgttaagggaataaatgattgatggttgagtagaatctagggaaataatcgagatgaaagaagcagtgttgtacaaaagttaagagctgcagatttgggcttgacaatttggaatgaaatattaggttttccactaaatagggctttttaacctatgtgcctcactttctacatctgtaaacttgggagagtaattcaagatgctacctacttcttaggattatcatgaggcttaaattaggtaatacatgtaaaagctcatagaacatagtctgataagtggaaaggactaatagatgttagctataaatcattattttcataatttgagttacatactctaagaaaggtccacatataccttactagaatagttatcaaactttattatgcaaattttattgtacaaatttgtttttttatgtattttgttttgtttgtttttccataggttattgggggtacaggtggtgtttggttacgtgagtaagttctttagtggtgatttgtgagattttggtgcacccatcacctgagcagtatacactgcaccctatttgtagtcttaaccctccccctccacccttactcccaagtcattaaagtctgttgtatcattcttatgcctttgtgtcctcatagcttagaccccacatatcagtgagaatatacaatgtttggttttccattcctgagttacttcacttagaataatagtctctaacctcatccaggtcgctatgaatgccgttaattcataccttcttttggctgagtagtattcctttgtatatatatgccacagtttctttatccacttgttgattgatgggcacttgggttcgttccatgattttgcagttgtgaattgtgctgccataaacatgcgtgtccaagtgtctttttcatataatgacttcttttcctctgggtagatacccagtagtgggtttgctggatcaaatggtagttcttttttttttttttttttaaattatactttaagttctagggtacatgtgcacaatgtgcaggtttgttacataggtatacatgtgccatgttggtttgctgcatcaacttgtcatttacattaagtatttctcctaatgctatccctcccccagccccctacccccccacaggccccagtgtgtgatgttccccgccctgggtctgtgtgttctcgttgttcaattcccacctatcagtgagaacatatggtgtttggttttctgtccttgtggtggtttgctgagaatgatggcttccagcttcatccatgtccctgcaaaggacatgaactcatccttttttatggctgcatagtattccatgatgtatatgtgccacattttcttaatccagtctatcattgatggacatttgggttggttccaagtctttgctattgtgaatagtgccgcaataaacatacatgtgcatatgtctttatagtagcatgatttataatcctttgggtatatacccagtaatgggatggctgggtgaaatggtatttctagttctagatccttgaggaatcgccacactgtcttccacaatggttgaactaatttacactcccaccaacagtgtaaaagcattactatttctccacatcttctccagcacctgttgtttcctgactttttaatgatcgccattctaactggcatgagatggtatctccttgtggttttgatttgcatttctctgatgaccagttatgagtattttttcatgtgtctgtgggttgcataaatgtcttcttctgagaagtgtctgttcatatcctttgcccgcttgttgatggggttggttttttctgtaaatttgtttaagttctttgtagattctggatgttagccctttgtcagatgggtagattgcaaaaattttctcccattctggagatattagccctttgtcagatggataaattgcaaaaattttctcctgttctgtaggttgcctgttcactctgatggtagtttcttttgccttgcagaagctctttagtttaattagatcccatttgtccattttggcttttgttgccaatcaaatggtagttctacttttagttctttaaggaatctccacactgttttccatagtggttctactagtttacattcctaccagcagtgtagaagtgtcctctgatcactgcatccacaccaacatctaatggtttttggttttttgattatggccattcttgcaggagtgaggtggtatcacactgtggttttgatttacatttctctgatcattggtgatgttgagcattttttcatgtgtttgttgcccattggtatatcttcttttgagaattgtctatttatgcccttagcccacttttagatgggattttttattttctattttttgctaatttttttgagtttgttgtatattttggatatatattagttctttgtcagatgtatagattgtgaagattttctcccactctgtgggttgtctgtttactctgctgactgttccttttgccatgcaaaagctctttaccagctatgtatctttgcttttattgcatatgttttgggatcttggtcatgaaatccttgcctaagccaacgtgtagaagggtttttctgatgttatcgtctagaatttttatagtttcttagatttaagtccataatccatgttgatttgatttttgtgtaaggtgagagatgaggatccagtttcattctcttacatgtggctagccaattatcctagcaccatttcttgaaaagggtgtcctttccccactttatgtttttgtttgcttgttgaagatcagttggctaagtatttgggtttattcctggtttctctattctgttgcattggcccgtgtgcctatttttataccagtaccatgctgttttggtgattgtggccttatagtatagtttcaaatcaggtagtgtgatgcctccaggtttgttctttttgcttagtcttgctttggctatgcgggctcttttttggtttcatatgaatgttagaattttttttttctaatttggtgaagaatgatggtggtattttgaatggggattgggttgaatttgtagattgcttttggcactatgtcattttctttgttgttttttttttatttgtttgtttgtttgtttattttgtttttgagacggagtctctctctgttgcccagactggagtgcagtgacgtgatcttggctcactgcaacctccacctcccaggttcaagtgattctcctgtctcctcctcccaagtagctggtactacaggcatgtgccaccacacctggctaatttttgtatttttagtagagacagggtttcaccatgttggccaggctggtttcacaatcctcacctcaagtgatctgcccgccttggcctcccaaagtgctgggattacaggtgtgaaccaccatgccaggcccagtatggtcattttcacaatattgattctacccatccacgagtgtgggatgtatttaatcataaagggatgctggattgtgtcatctgtgattttgttcagcagtgttttgtagttttccttgtagaggtctttcacctccttggttaggtggattcctaagtattttattttattttttttgcagctattttaaaaggagttgagttttttatttgattctctgtttggttgctgtttgtgtgtagaagagctactgatttgtgtacattaattttgtatccagatactttgctgaattcttttatcagttctaggagctttctggaggagtctttagggtttttgaggtaaacgatcatatcatcagcaaacagtgacattttgacttcctcttcaactatttggattccgttttttactttctcttgtctgattaatgtggctaggacttcgtggtgagagtgggtatccttgtcttgttccagttcttagagggaatgctttcaacttttccccattcagtgttatgtcggctgtgggtttgtcatagatggcttttattacattgaggtgtgtcccttgtatgcccattttgctgagagttttaatcataaaagttgctggattttgtcaaatgctttttttgcatctattgagatgataatgtgatttttgtttttaattctttttatgtgaggtatcacatttattgacttgtgtatgttaaaccatccctgcatccctggtatgaaacccacttgatcatggtggattatgtttttgataatgttgttggatttggttagctagtatttcgttagggattttagcatcgatgttcttcagggatattggtctgtagttttcttttatggttatgtcctttcctggttttggtattagggtgatgttggcttcatagaatgaattagggttggttcccggtttctctatcttgtggaatagtatcaataggataggtataaattcttctttgaatgtctggtagaattcagctgtgaatctgtctggtcctggacttttttctgttgttaatttttaaattactgtttcagtcttgctgcttgttattggtctgttcagggtatgtattttttcctgatttaaggtaggagggttgtatctttccagggaattatccatctcttctaggtgttctagtttatgcacattaaggtgtccgtagtagccttgaatgatcttttatatttctgtggtgtcagttgtagtatctcccgtttcatttcttattaagcttatttggattttttgtctccttttcttggttaatcttgctaatggtctatcaattttatttatcttttcaaagaatcagctttttgtttcatttatcttttgtatttttttgtttgtttcaatttcatttagttctgctctgatcgtggttatttcctttcttctgctggttttaggtttggtttctctttgtttgtctagttccttgaggtgtgacatgagattgtcagtttgtgctcattcagtctttttgatgtaggtgtttagggctatgaactttcctgttagcactgcctttgctgtattccagaggttttgataggttgtgtcactattgtagttcagttcaaataatttttaaatttccatcttgattatatttttgacccagtgatcattcaggagcaggttatttaatttccatggatttgcatggttttgaatgtttcttttggagttgatttccagttttattctgctgtggtctgagagagtgcttgatataatttcagttttcttaaatgtattgaggcttgttgttttgtggcatatcatatggtctatcttggagaaagttccatgtgctgttgaatagaatgtgtattctgcagttgtagaatggaatgttctatatatctatatatatatagatatatctgttaagtctgtttgttccaaggtatagtttaaattgattgtttctttgttgactttctgtcttgatgacctgtctagtgctgtcagtggagtattaaagttccccactattattgtgttgctgtgtatttcatttcttaggtctattagtaattgttttataaatttgggacctccagtgttaggtgcatatatgtttaggactgtgatgttttcctgttggacaaggccttttaccattatataatgtccctctttgtcttttttaattgctgttgctttgaagtttgttttgtctgatacaagaatagctactcctgctggcttttggtgtgcatttgcatgaaatgcccttttccaaccttttacttcatgtgagtccttaagtgttagatgagtctctggaaggcagcagatggttggtgaattcttatccattctgcagttctttctgtctttcagatggagcatttaagctatttacattcagtgttagtagtgagatgtgaggtaccatttgattcatcatgctatttgttgcctgtgtaccttggttttttgttttgttttgttttgtttgctttttaaattgtattttttataggtcatgtgagatttatgctttaaataagttctgttttgatatttttccaggaattgtttcaagatttagaacttcttttagcagttcttgtagtggtggcttggtagtgacgaattttctcggcagttgtttgtctgaaaaagattatatcttcatgtatgttgcttagtttcagtggatacaaacttcttggctgagaattgttttgtttgaggaggctgaagataggaccccaatcccttctagcttgtagggtttctgctgagaaatctgtggttaatctaagtttccctttataggttacctggtgcttttgtctcacagctcttaagattctttccttcgtcttaactttggctaacctggtgacaatatgcctaggcgatgatctttttgtgataaattttccaggtgttctttgtgcctaggtctctagcaagactggggaagttttccttgattattccccaaaatatgttttccaagcttttagaattctcttcttcctcaggaacaccgattattcttaggtttggtcgttgagcataatcccagacttctctgaggctttgttcatattgtcttattattttttctttgtctttgtaggattgagttcatttgaagaccttgtcttcgagccctgaatttctttcttctacttgttccattctattgctgagactttccggagcattttgcatttctataagtgtgtcgtatgtttcctgaagttttgattgtttttttatttatgctgtctatttcattgaatatttcttcttcacttcttatatcatttttttttatttccttgcattgggcttcgcctttctctggtgcttccctgattagcttaataactaatcaataatcttcagaattctttttcaggtaaatcagggattttttcttggtttgtatcaattgatggtgagctagtgtgatttttggggggtgttaaataagcttgttttgtcatagtaccagagttggttttctggttccttctcatttgggtaggctctgacagagggaagatctagggctgaagtctgttattcagattctttggcccacaggggtttcccttgatatagtactcttccccttttccaatggctgtggcttcctgagagccaagctgcagtgatggttatctctcttcttggtctagccatctaccgcgcctacccggctccaggcttgtactaggggttgtctgcacagagtcctgtgatgtgaaccgtctatgggtctctcagccgtggataccagcagctgttccagtggagatgacaagggggtaaaatgaactctgtgaggggtcttagctttggtggtttaatgctctatttttgtgctggttggccccctgccaggaggtggtgctttccagagagtatcagctgtggtagtatggggaggaaccagaggtgggtggggccctagaatgcccgagtgtacaccctttgtgttcagctaccagggtgggtagggaagtgtgtccggaattggttccttccagtgggttcttggtctcactgacttcaagaatgaagctgtggaccctcgcagtgagtgttacagttcttaaagatggtgtgtctggagtttgttccttcagatgttcagatgtgtctggagtttcttccttctggtgggtctcgctgacttcaggaatgaagccgcagacctttgtagtgagtgttacagttcttaaaggtggcacgtccggagttgtttgttcctcccgatgggttcgtggtctcgctgacttcaggaataagccacagaccctcgtaatgagtgttacagctcataaaggtagtgcggacccaaacagtgagcagcagcaagatttactgtgaagagcaaaagaacaaagcttccacagcgtggaaggggaccccagtgggttgctgctgctggctcaggtggccagcttttattcccttagttggccctgcccatgtcctgctgattggtccattttacagagtgctgattggtgcgtttacaatcctttagctagacacagagtgctgattggtgtgtttttacagtgtgctgattggtgcgtttacaatcctttagctagacacagagtgctgattggtgcacttacaatcctctagctagacagaaaagttctccaagtccccactcgacccaggaagtccagctggcttcacctctcagaaggaccatcaggtgggggcagggcccaggatgtctgagctcagactctccttgggcaggtcttgctgcagctgctgtgggggatgggggtgaggttcccaggtcaatggagttgtgtacctaggaggattatggctgcctctcacacgtccttcaggttgtcagggaatttggggaaagccggcagtcacaggcctcacccagctcccacgcaatccacaggggtggtctctcccaccatgcccctgctagcagcaccaagtctgtttccaggcagtgggcaagcagggctgagaacttgcaccaggctacctgcttcccatctgtgaaagaaagtagggctttaattttcctgttcaagttgttaccaagatcagctggagatttccttctccctgtggcattttcccagtgcctctggccgccctccagaaagatccctgtaatgccagacaggaatggcttgcttgtggacccagaaagctcacaggactttttcctctgatgcctctatccgtgtatttcgcttggctgtctaaattgactcagctccaggtaaggtcagaatcttttcccataaactagacattaagtttccccagtgaggatgtgtgttcgggggctgagaatctccctttcccactttctcagtttgggcagtcacattatctcaggtgtctcctgggtcctgcaggagcggtcctctttcttcagagggtctgtgggtcctctcgggtttcctgatttattcctgcagtcgttctgtagccaaaattcaccgtgtgaacctccacacgctgctctgttcatcccagtcagagctgccatgtagtcctgcctcccatccaccatgacagccaatctccctgctgcacaaatttgtgaaaaacgtatattcccatgtcatggtgaagagattctgattcattaacataaggatgagacccagaaatagatgtttttaggaaacatcatagataacctgataaataacatattttcagaaattttctatgggtttcaaaaagtgtaatagttgcactatggtggtaataactgatacattcaggtactactagtgaccatgtaaatcataaaactttggaaacaaatttgccattttctaaagagttattaaaatgttatataatttgattcaattatcttattttttattgttttttgtaaggcagtaatctagaaggttattttaatttatacattatttccaagattttgatattaaaagtgacatagaatctaaattattgtttatctgctcaatggatcattatataaccattaaattttataattatgaatactgtagtatcagggaaataaaaggtagataaaaagcataaatctcatttatttgtacagtacattttcaattgtctaaagattgtctaaaaataaagagtaaaggaatatgttcaaatttaaagtagttggttttggccaagtgtggcagctcactcctgtaatcccagcaaaatgagaagctgagatgggcagatcacatgagaccaagagttcgagaccagcctggccaacacggcgaaaccccgtctctactgaaaatacaaaaatttgctgggggtggttgtgcacatctaaaatttcagctacttgggaggctaaggcatgagaatcacttgaacatacttcttgaataaagaagtcacttcctggactctaagccaagagtctaagccaaatatcagaccagtttttccagggggccttattagcattcatttgttaaagtcaaccttagtttcttaaagctgaccatcatatctaattttgcacatcatactcactaatggtttccagattctggaggaatcaagtagagagaaaaagtaattatttcaattttatttataaaaatataatctaggccaggcatggtggcttatgcctgtaatctcagcatttttggagtccaacgcaagtggatagcttgagcctaagagttcaaggctgcagtgagctatgatcacaccgctgcactcttgccttattgatggagagagatgctgtctctttgtaaaaaacagaaaaacataacctaccacattgcggtaaactataaatatcctaagagaaaatgcttttcttaaatctggaagccaaagcacaaaagagccagcaaaattttgaagaaaaggttattaaataattataatcacccttttcagtttatttagtcaaatctaattaagtcttattctgctgtatcttggcttggcaattttatgagctcatcagttgctttattagagttgtggaaattcttacccagtccaatggtatgatcttaaagttatcagaaacctttattctgtagcacttttcagagccttttccattagacactttggcctatatcagattgtaaatgctttcagagaagaatcaaagtaaaacaataaattgagaatgacaaaaggcttaaaatcaccataaagatctgatgagagtttatttgctaaggaaatttatttattgctgtggctaatgatattttaacataataattggaattgtgactggtaacattatgccaaacctatcatgaataacatattgacaaatttctatcaactttatataactcctgaaacacttatattaataacatatatctatatacatataacctaaagaagatatagcatcagttcttatttgacagtacttcctctgtaatttaacaaatcaaactaattaacataacatctctcttttacaaggcaagagacaaatcctttgatattttccaggaaccctctgggaactctcaatgttaatttaaagtcaaagatacgttatgtagaatttgatttgggccgggcacagtgcctcatgcctgtaatctcaacactttggaaggccgaggcaggcgaatcacctgaggtcaggagtttgagaccagtctggccaacatgatgaaacctcgtttctatcaaaaatacaaaaattagctgggcatgttagtgcccgcctgtaatcccagctactcgggaggctgaggcaggagaattgcttgaacctgggaggcggagcttgcagtgagctgagattatgccattgtactccagcctgggcagtaagagcgaaactctgtctcaaaaaaaaaaaaaaaaaaaaggaaaaaaaagaatttgatttaatttgggaaagtttgtcaaaaatgtcagaaggttttaaacactagaatcacacatcattataaaacaatacttatatataagtattgtttattactttattacttataaacaaagtaataaaatattttataagcacatatagaagttacatagttgtaaataaaactgagtacttttaacattgaaaggattccgcttttttaagtaatcaaaataactgataaaggtaacatgaaattgttcaaaataactgataaaggtaacatgaaattgttctaacatacaaaaccttgattttctaggcagattacttaaaaactgggggaaaaccctttcacgatatcgttatcaagagcagacaggtaatccaagaaaagtatgtcattttaacagagaacacagaattctaatatggcatgtgttctattaatactaaggctttgtttgtttgttttttgtttttaagagacaaggtctcactctctgttgtccaggctggagtgcagtgtagctatcatagctcactgcagcctcaaactcctgggctcaagtgatcctcccacctcatccttttgagtagctaggactacaaggatatgccgccatgcacagctaatttgcctaatttttgtggagatggggtctcactgtgttgcccagcctggcttgaactcctggcttcaagtgatccccccacctctaatgctcaaattgctgggattacaggagtgagccaccatgcctggccactaaagcttattaaaaaacaacaacaacaaaatacttttgactaaatctgtccaatcttagccaactctaccacacaaaataagatcctgtttccaagattacttttccacaaacctgtagttttaaaaaatatattcagtttttgtcctgttcttttttctctttctctttggcacaaccagtcattcttactttaggacaaagtgacactctttttcccttaacaaacccacatccttcattcttttcctcatcaaaaaacacattctacttcccttgaatactttgcatatagggttttttcctgattagatttttttgtgtgtgtgacagggtctcactctgtcgcccaggcttgattgcagtggcacaatcgtagatcactgtaactttgcactgctgggcttaagcatacctccacaaccaactaattttttaattttttgtaaagagttctctgttgtaaagactcatctacttgtaaagacgagttataaaaagtttataaccttttatgaatataatttataaaagtttataactttataaatataaacttttataaattatatttataaaaggttataaccttttggttataaaaggttaaccttttggttataaccttttataaatattatttatgaaagtttataagttaacgtgctttcatctatttaattcacttttaataattatgcttggattgctcatgaaaatttcatgagacactgctcaaaggtagatattctcttaaattttgttgttgacaaatcagacaagtatctaaaatatcacagaagcaaaaatcctaataaacaaaaaccttgtttttgcctttttaaagtgtatacatcaattcatttttattgtacatttgattcttaggttgcatttatagttttattctcataaatatctggtagagatagcataagtttgtttgatgagtaaacctaagtggaaaacaattatatgtcgtattatgtttaatgctgacaactctgacaacattcctgtttttattttaccaacaatctttaaaccagttttatttaccaaagattatcccagatcacatgaacctaaaataattaggttagttttcatatttttgagagttttaggaatacctagtttatacaagcactgatttttctttacatcaattaaatggagcccttttgtataattttctatctggagatagaaaaatatcacaaatctatgtcatgcatacatacacacacacacacacacacacacacacacacacaaacagattcaaataaagatcttacaggtttcatttgaaaatttctgcaatgagtcaataaaacatagtaatgtgaactcaactggtttatataaaatcttgtcttttcgccagcttatacttttattcaatttgtgattctggcatatgggacaaatcgaggttagctactcaatatgaggaccagtgcttttcaccaatatttggggagggtttttttttaagattttaattgcccttctgataggtaattttttttatttttctttttccacaacaaattcagatcttccaatcataagtagtataatggcagctgtggacaaaacttcagacaagtgactaaggagacatctagcagctgttcagttttctccaaactctgtctgagaaaatacaatacccaatctatttccaattagcctttcttttttatttttcagcagaccccctgaagcccttgagaactgagattcctaaagttcaagttactgaggggctggagtgggaagggaaaatgtctaacaggggtagatagagggatgcaggaggtaggggcttggagagaggaatatcaaggattcaagggatgtgcctttccttcaggtataggtagggtacctcttacatgagagtcttaaaatctgcttcagaggaatgccattaagtccttcctacacgtgatttctcacatgccttcagcttagaatattcagtataccaactgaatattttgtgatagcatgtactgaactcttcattagttaaaagttgctaaagtttaaggaagagagcatttaattctcaccctatcatattaaaaattgtatttgaataccctgaacgtagagaaaaagctgggcccagaactaaaataatatcagggtacctgatattggaattttgaactgaattgtgtctcctccaaatttatatgttgatgcactgattgccagtgtgactgtgtctggtctttaggaggtaattaaggttacatgagatcataaaagtgtggctcttcttatagggccacagtcttaatgcaataggacggtggccttataacaagaatacagactcacctccttctcttcctcatgacaacactgcaagaagatggctgtctttgagccaggaagaaagccctcatcaaaacctggccatgctggcaccctgatattggacttttgttatgtaatccacccagtgtatgtattttattacagcagccctacctgattaacacatctgccaagctgaaatgttggacacctgtcaagtttaaggtgtatgtaattgctttcttcagtcttgatatagataggtctttatttagttctaatctttttttcccttcatatttgttgccctcactggaaaacagtatgttttatgtagcagtaagagccttgtaaataatgtttttcaagtgaggacaggacagatagtgtttttgtttgtttgtttgttttgtttgttttttgacagtgtcttgctctgttgcccagtctggagtgcagtggcacaatctcggctcactgaaacctccgcctcctgggttcaagcaattctcctgcctcagcctcctgagtagctgggattacaggtgcacgccaccacgcctggctaatttttgtatttttcatagagacagggttttaccatgttggtcaagctggtgacagatagttttagttgcccccttcctatgaaaatacagaatactgaatccagtttttgtgtattcaattaaaattccactaatgcttcagcttttttaacaagaaaatatttctgttttgaatgtttaacacagagtcacaagatagtcatgtatgcatgcctggtattgaaaaaatcagtaaaaaactgataacttactgactatccaaattgttactatactttgatgtttgtattgtaccatgatgataaatctggtccttagcatagtaattgttattttcataatctctaaatcagtttcttctgggttctgagatccaaaaagatgaaacaaagactaattgttgactgaaagaaatataagtaacagctactgctaacacattttaaaattagaatgcataaattaacaaatagtgccaaaaagtaaacacttttttgcaaggcaaatcatatgccttatctactcccgttcaaattaataaaaatacactatttataaacatgtactactgtactttccttttagctttatttcagaaaaatgtggaataatttacacttccacctctcaggatgctgtcagcagtagcataatagcaaaagtagaagcattttgaaatttaaaaaaggcagaaattaattaaatttaaaacaaattaaaattaaaatatggtggcattataaagatgtgttctgataaaagtctagtatattttactattttgagaagcaaatcaactcatttatgaatccttttaatatttttctgtatttaattgcatttgctagagcagtcttcttctagggatgtttaagatccctttactattaatagctggaaaatgaatagtcagagtactgattgatgatatgatgattttagactattattattttgcatttatatagcatattgcctcatatgtattcaaatatttcataaaagcagttatcagaataacaaagtctgtatttgcacacaagtattacaaacaatttaaagatacacagattgaccctccctcatctgaaaatctgaaatctgaaattctctaaaatctgaaatttttgagtgctgccatgatgccacaggtgaaaaattgcacacctgacctcatgcagtgaattgcaatcaaaactttatttcaagcacaaaattattttaaaatattgtataaaaatcatctttatgctacgaatataaggtatatatgaaacataaatgaattttgtgtttagactttagtcttatatgatttggctgtgtcccccctcaaatctcatcttgaattgtaactcccacaattcccacatgtcataggaggaacctggtgagacataattgaatcatggtggctggtctctcccatgctgttctagtgaaagtagataagtctcacaagatctgatggtttttaaaacgggaatttccctgcacaagctcactcttggcctgctgccatcttagtaagacgtgacttgctcctccatgccttctaccatgattgtgaggcctccccagccacgtggaactcttaagtccattaaatctctttcttttgtaaattgcccagtctcaggtatgtctttatcaacagcatgaaaatggactaatgcagtaaattggtaccagtagtgtggggtgctgctgaaaagatacccaaaaatgtggaagtgactttggaactgggtaacaggcagaggttggaacagtttggagggctcagaagaagacaggaaaatgtgggaaagtttggaagtccctagagactcgttgagtggctttcaccaaaatactgataatgatatggacaatgaaatccagactgagttggtctcagatggagatgaagtacttgttgggaactggagaaaaggtgacacttgttatgttttagcaaagagacttgcccctgccctagagatttgtggaactttgaacttgagaaagatgattagggtatctggcacaattgatttctaaacagtaaagcattcaagaggtgacttgggtgctgttaaaggcattcagttttaaaagggaaacagaacataaaagtttggaaaatttatagcctgacaatgcgatagaaaagaaaatcccattttctgaggagaaattcaagctggctgcagatacatgcataagtaataaggagccaaatgttaatccccaatacaatggggaaaatgtcaccagggcatgtaggaggtcttcgaggcagcccctttcatcacaggcccagaggcataggaggaaaaatggtttcacgggctaggcccatggtccctgtattgtgtgcagtctagggacttggtgccctgtgttccaaccactttagccatggctaacaggggccaaggtaaagcttgggatgtggcttcagagggtgcaagccccaagccttggcagcttctacatgatgttgagcctgcgagtgcacagaagtcaagaattggggtttgggaacctctgcctagatttcagaggatggatggaaatgcctggatgtccaagcagaagtttgctgcaggggtggggctctcatggagaatctctgctagggcagtgcagaagagaaatgaggggttggagcccccacacagagtccctactggggcacggcctagtggagctgtgagaagaggatcattgtcctccagacttcagaatagtagatccactgatagcttatactgtgcacctggaaaagcagtgcacactcaatgccagcccatggcagcagccaggagggaggctgtaccctgcaaagccacagggtcggagctacccaagaccataggaacccaccttttgcatcagcattacctgaatgtgagacctggagtcaaaggagatcatttgatttgacgtaagatttgactgccttgctggctttcagacttgcgtgggggctttagcccctttgttttggccaatttctcccatttgtaagggctgtatttacctgtaccctcattgtatctaggaagtaactaaattgcttttgattttactggctcataggtaaaagggacttgccttatctcagatgagactttgggctgtgaacttttgagttaatgctgaagtgagttaagactttgggtgactgttgggaaggcatgattagttttgaaatgtgaggacatgagatttaggaggggtcggggtggaatgatatggtttggctgtgtccccacccagatctcatcttgaattttaactccctcaattcccacatattgtgggaggaacctggtgggaggtaattgaataatggggttgagtctttccaatgctgttcttgtgatagtgaataagtctcagctgatctgatggttttaaaaacaggagtttccctgcacaggctctctcttggcctgctcccatccacatataaaacatggcttgctcctccttgccttccaccatgattgtgaggcctccccagccacatcaaactgtaagtccattaaacctctttattttgtaaattgccctgtctcgggtatgtctttatcagcagcgtgaaaatggactaatacatatccccaggatatctcattatatatgtatgcatatattccaaaatccaaaaaaagttgaaatttggaaaaacttctagtccaaagtatttcagataagggatgttcaccctctgtctgtccaaaaatcatgaacgaagatctagtttgtgtgtagaaagttgcagtttcaccctaaaaagcaaaacaagctggataagtcatataattcaaagattatataatcaaaattttggttatagcgatctacgagtagttgcctgaggtagagggaatttactagaaagggaaatttgagatctttcttggatgatggaaatagtctatatgttgcttgggtggcagtttcacaattacataaaattgtcaaaatccatcaaacataacatcagagatcattattttttgtatatatattaacttgatatgaaaatctgaatgtggtttaatatgattcaatttgcatttaatttaaaatagattaatttagcaacagtagcaacagtgaaggtggaatacgttgaaaataaaggttatgacttttgtgggcactgatagtcaatgggttgtcagaaagaagagtagtaattcccattttttgtgtggaaccatggatactggtagaaaattttttcagttacactagttctgatctgatctcccactatgattgtataaagcagtgaaaactcatttaatattcttccaggactttcatttatcaatgcctaccaggcagtgataatcaggatagccatatgctttgtctactcttggttaaattaatggaaacaacaacaactttatataatatggtaactatactgtattgtggtagtcaaagttagattcatttagcttgctgcaatgcatagggaggctgtgcaaggagctaaggtattttggtacaagaagttactaggaattcatcataggattcagggttgtgcttaaacgtggtttccgtggactcagtgtccttagagtctgctaggctccatgtgggttcttccttttgtgtcagcctccaggaaactcactcaagcctttgaaaatcaggctcacctatttgtttcctgtctctctggaatcactatctttactcttgagtttaatcgtttgaataccaagctgttgatatatatatcttctgacttttttaggtgttttagaaaatagggaaaatccagtatctttattccttcttggtcagaaataaaagttctcatattttttttactaaaatgttggggtagggtgatatgtggatagacaaaaaagttaatatgccagtgcttatttgtaaaacataaagcttaaatgaagaaaagtaatattaaaatagttatacatcgttttttaaacactatgttcaaggcatcttgatctgtggaattatgtattttagctaagttgtactaaatagtactgattcagatatacaaatcataatacttatcagctaattgaaagctccttgagaggaatatttaatggtttaattttgaacatactacatattttaagtatcaaatgttcagtaaatatatatgtggaatacatgttttctgtgtcagacactgatatggtttggctctgtgcccctacctaaatcttacctcaaattgtaatccccatgtgtcaagggaaggacctgtaatcttcatgtgtcaagggatggaggtgattggataatgtgggtggtttcccatgctgttctcgtgatagtgagttctcacgagatctgatggtttgataaggcagttttgcctgctcttgctggctctctcttgcctaccgccatgtaagacatgccagcttccccttctgccatgattttaagtttcttgaggcctccccagccacatggacatgtgagtcaattaaacctcttttctttataaattacccagtcttgggtagttctttatagcagtgtgagaacagactaatacagtaaactggtaaagtggtgagtgaggtactgctatagagatacccaaaaaggtggttgtgactttggaactgggtaacaggcagggattggaatagtttgtagggctcaaaagaagacaggaaaatgtgggaaagtttggaacttcccggagacttgctgaatggtttttactaaaatgctgacaatgaggtggccaatgaagtccaggctgaggtgatctcagatggagatgaggaacttcttggtaactggagcaaaggtcactcctgccttgctttagcaaagagactagtggcattttgcccctgccctagaaatctgtggaactttgaacttgagggagatgatctgaaattggaacttatgtttaaaagggaagcagagcataaaagtttggaaaatttgcagcctgacaatgtgatagaaaagaaaaatcaattttatggggagaaattgaagcccattgtagaaattttcataagtaatgaggagtggaatgtgaatagccaagacagtggggaaaaatgtcaccagggcatgtcagagatcttggtggccacccctcccatcacaggcccagtggcctaggaagaaaaaatggtttcgtgggctgggccctgagcccctctgctctgtgcagccttgggacatggtgccttgtgttccagctgcttcagctccagccatggctaaaaggggccaaggtacagtttggtccattgcttcagagggtgcaagccccaagccttagtggcttccatgtggtgttgggcctgagggtgcacagaagtcaagaattgagttttaggaacctccacctagatttcagaggatgtatggaaacacctggatgtccaggcagaagtcgggtttaggggcagagccctcacagagaacttgtacaagggcagtgcagaagggaaatgtggctttggagcccccacacagagtccccactggggcactgcctagtggagctatgtgagaagaggaccaccaccctccagaccccagaatggtagaacactgacaaccagtaccatgagcctagaaaagccacaggtactcaatgccagcccattcaccaaagctgcccaaggctgtgggagcccacccattgcatcagcgtaccctggatatgagacttggagtcagaggagataagctttcaaattgagtgactgccccaatggatttagaacttgcatggggcctgtagcccctttgttttggccagtttctcccatttagaatcggtgtagttaccaaatgcctgtgccaccattgtaacttaaaagtaactagcttgggtcctttttgagatgcagtgttgctctttcgcccaggctggagtgcaatggcacaatctcgactcactgcaacctccgcctccccggttcaagcgattcttctgcctcagcctcccatgtagctggtactacaggcacgcactaccacacctggctaatttttgtatttttagtagagacggggattcaccacattggccaggctgctcttgaactcctgacctcgtgatccacccccctcggcctcccaaattgctggggttacaggaatgagccaccgcatctggccttgttttttattttacctgcttataggcagaagggacttgcctgtctcagatgacactttggactgtagacttttgaattaatgctgaaatgagttaagactttgggggactgttgggaaggcatgattggttttgaaatgtgaaaagagatgagatttgggtgaggccaggggtggaatgatacagttcggctctgggtccccacccatatcacatcttgaattgtgatccccatgagtcaagggagggagctgtaatctccatgtgtccagggaaggagatgattggatcatgggggcagttttcctcatgctattcagtaataatcagtgagttctcatgagatctgatggtttaaggcagttttccctgcttgtgctaggtctctcttgcttgtcgccacataagacatgcctgcctccccctccaccatgattgtaagtttcctgaggcttccccaaccatgcggaaatgtgagttaattaaacctctttttttttttttgtaaattaccctgtctcaagtatatctttataacagtctgaaaacagactaatacagacacctagcatttcttattagaattcataatatttattccttccctgagcttaagagccattttcaggtaagatgagaactaacatctatttatataaatccaataaaatatatgaattttgattacaaatgctaattttcactcagttttaagcttctatttcttatgctagtttctcttcattatgttgctatagatctactgattatccactttatgtctttctaaatattcctttatttactgatatattaaaatttttgaacaattaactttatttatcaaagactaacataattcctgatctcttggtagttaagtggggaaggcacatatctatcaaataagcactctaatttgtatataattaaggctgaaataactataccagaattaaggataaagttttgtaaagactgaaataatctattaagtctcatgcacagaagagacatagttcaggaggtattttggatgaaaattgccaaagatattgtagctgaatcccaaacctgagaaatattcttggttttttagtatttttccttcatcaccaccgccattgccaccatccctcttcagtctagtccattaccaaatcccattagctccttctccaaaataacatcaaatccaactatattatctattctaccatcaccctggtttaagccaacatcatctctaacttgaacttgcagtatttctaaatatctgtttccattcctgtcatcctttaatccattctctatatagcagccagagaaaccttttattaaccgtaaatcagaccatgacatttttcttcttaaaaccttggtggctctctataacattcagaatgaagtccagtttattcaggataggctactagaccctggttcctgaccttctctccaatctcatctcatcaccattttattatttatttatttttctcctcactctcttcctacaagctatgctggctgccttttcattgcaagaataaaccaagctccatactattttggtgcctttcagtttttgctgtcctgtacctagaatgtttttctccagttttttacttatttggctcatcgatgttaaaatcagatcacctcttcagataggccttctccaataaccttgtctaaagtgacctcaagttattgtattaacttattttctccctcatttaattttatctccttaagttctgtgaaagctatgaattcattccatttatctttgttgtagctatctttgttggcacttaggtgctcagtaaaaatactttttatgtggatatttccccagtcttcttagtaaagtctgaactataatgaaggatcataatcatagcaaacatttatgtagtctccatataaattaataattgacagttgatgatttctgaaaaccataatccgtattcactcagtaagtgagtattttatattatagctgaaaatagcttacttttaaaggtataaagtaaaggataaggactcatacacacttataaagtctaaagttgttaattcagttcaacagataatttacatttaatactgaaattcactatttactatgttcagtgttgtgttaggcaagctgtctagcttaaaggacactaatgttcaacatgaattctaaatggagtaagtaattggagatctggtatagaaattgagtgaaatgcattattaaaatccatgaaaaccaacaagtcttagtagttattctttacaaaagccataattaagacccacacctcccaaactgtgcaccagggtaccccagactgccatagaaaactcttagggataccataggctttttttaaattttgagggaaaccagcaacatctgtcagatactatgtaaagtactatctcaaggtagttcgcagtttcagtgttagattgtacctttgatgatgtcacatctttatgaagctgggttttgcacagttaactgtgagaaaaagcaagtactacaggaaaattattgtggaagaggaaaggagggcaacagtatccaatatgattcaaaggtttaggatatgtacagggcccaatagttgtacccatcccattagtaagtaattgtagttactattaataattatttaaaattaatatgtttttactttcaatttgtatctattatttaacagctactaatttgttaggatataaaacttaagttgtttggaccttactacttaataaacagaactattagatacttcttttactgggtgccatgaaaacattattgagacacccagagcaccttgaactgagaaagtttgagaacttctgatatagccaaattttattttattttatttttatgattcaaatatcattttattgttaatagcatctttctggagatctggtcttcaacagactctctagaagaaatttatgtttatgataagtgggagactatactatagaagcatagagaaagagaaataatatttactgggtacctactatgttatagacattatttttatttcttgtttaatacttatagcaatcttaagatatataatgatgatcttcccattttatagacagggaaccaaaggtcaaaaaaattagatattttgctaggttacacagctaactggatggtgcctgaagaagctaaaggctttttatggcaatgactaatgtattattttcaacttaagaaagttagttggatggagtgacaaaggaacaaagatctactatattgtggattttattactgtaaataaacactgaaggttacttttttttttaaattcttagtccctattattcatgcaagtttttcatgtcatttgctggatcattaaatttgagtatatttggtagtcttatttccataatagagaatcagtgaagattgttttagtgtttcacatagttaaaattgtattttggtcacctacaacttgataatctatagaagttaagtactaccgagttagattttcattgaattttttattttaactgttttctttcttttttttttctttttttttttttgagatggagttttgctcttgttgcccgggctggagtgcagtggtgcaatctcggctcactgcagcttccgcctcctgggttcaagtgattctcctgcctcagcctcctgagtagctgggattacaggtgagcaccaccacacccagctaattttttgtatttttagtacagacggggtttcatcatgttgtacaggctgatgataacctgaactcctgacctcaggttatccacccgcctcggcctcctaaagtgcagggattacatacgtgagccactgtgcctggcctattttgactgttttcttgcctgtgtgccttgtaattataaagaaatttctggaacccatacaaagatattttctatttgcacttcattttctgttagcctcttctgaaacttctgcagtgttttgaattatctcaaccattctccacatctcttaacctctgtttcttattttctttctttttatctctctttgctgaattctatatcacttcttgagacctgtcttccagtttatgaattttcctttcatctgtatctgatctcctacagtcttctgagtttgtttctccagtcctaaaattattatatgtttcattcatgggaaccctggttggttattttcaaatctgcctagtaagttttcttacattttgtacttttctaggcatattaaacatattaatgttttctaataattctaatatttacagtatttttaggtctggttctgtagttcgtcgtttctacatatactttttgtggtagtatcccctttcccttccccttcctcttcctgttctcccttcctctttctttttccccttccctttcccctctttcgggcttttgagtgaatggagttcattccttcatggagaaatttgattctcccatgcacatgggatactgtcaatgtgaaaccactttcaattttggggtggtgtggattcaggccataaccctgcacaaatgtggatttgtggttattaattctcagggaagcccctttttctttttttttcttttcatattctacccaatccaaggtagacaggcatgtatctctttcaactccctttttggagttttggttgtttttcttagtttatccttttgggtgttactgactgcatctgaattttatgtgatatgacttcacatccatattgaactctgaaagcctggcttttaagcactgggctctttaataccaaggctgtaggccacacatcagcagataccaccagagtccagcaaatactggccccagaactctttccttttctggatttatgattcttttttgcttacagcctttatgaattcttttagtttccaaccagccaaccgtgtgcttaaataagtctttaaaaatgtgtattatattcacactttttagatgtggtatgctagaagtgaccttaactgaatatgttggtctgctatagtacaaaaaaaagcaattcattaaatattttgaatgacagcacaggattctgtgctgactcaagttagagcaagttacacactttagaactcttctctgaatttgctgtcactttacccaaaagtagaattagaactctttggctgccctcaccatagccaagtgactcctaatcctccagggaacatgtaaaatggtaaaatttgcctgaaaaatacagctgactttcataagactacagcaaattttgaaaggtacattggagcagtagtagtgataggaaaccaattgttaggctttctatattcattcttgaacggttaccccaaaagagtatcctaaaattcaagttaaaaattaaaacactgttaatttaaaactgtcttttctgtttcagtttaaaatgttaaatcaaaacagactttcttcttaccctaaaatagttacataagaacagtctgttgtcacagaagtcattctattataaagttactttattataaagggtatagtctctatttaaaatgttaagctacaaatatttatccttttgagccatctgtactgctaaatacccataagtattttagactaagatctgaaaaatggaaatactttaaaacctttgcattgttgattcttgattttttttatggcgtgtgtcttgctttgagcagaaatagattgatgcagacagcttacttgtaaaacattatgttactgtcatttaaaaaaatagttttaaaccctctgatggaaaggggcatctttagatgaagtaatttcattaaaatatccaattcagaatctaagtaaataaacttaaatatataaaaattcttcacttaatgtatttattcccataataaatatgttaatttcataaatttagagctctgttaggtgaatttattttattattttaaatcattaccttagctaacccagaaagtttctattgagaatgtttgttccccactttctcctcatgaaatcattttaatactgtataataccaggaaattgattaatgtcattaatcaactattattatggatatatattttattggatgcttatttcatatttcctttttgggtggcgttctattgaaacatgtgagaaaatattagtaacttgtctactctgcttacccccatcttatataaaccccatttccagaggactggaaactggaaagaagaatacctcagggctgaacatgacaggggcttaagaaaagtatctgagaaattataaccaaaaactgagcctagaatgaatttgcaattcaaattcatattgtctgcactgtataaaaaaatttacattttttcttacagcttttttttttttttttgagacagagtctcgctctgtcacccaggctggagtgcagtggcacaatctcggcgtactgcaagctctgcctcccaggttcatgccattctcctgcctcagcctcccgagtagctaggacaacaggcacccgccaccacgcccggctaattttttgtatttttagtaaagatggggtttcactgtgttagccagaatggtctcgatctcctgacctcgtgatctgcccgcctcagcctcccaaagtgctgggattacaggcgtgagccaccacccccggcccctgcttttttttttttttttttaaacaaaaccatcaatggaaggaaaaacactttaagtgtatgaatttagtttaaagtagtctatgatggatagtgcgttcggacaactgaccaaaacaaatgcagattctctggtgaattcactttgtcctaaaattcaaagaaataccatacattatttaccactgaacacgaaaagctacaaggaaatgaagtactatgaataagaatcatcagaaacactaagcagctgaatcaaccctacatagacattaaatattggaatgattggatatagagtaaaaaacaactatgcttacttaatatgttaaacaaaataaaactaaaaagcaaaagcctaaaaaaaatcaatagggaacagcaaactgtaaaaatgtcctagcaaatttggaaaataatcaattagaaattctagaattggaaacaaataatctaaatttaaaatcacatggagtataacagcagaacagatacaattgaagagagaaatagcaaagtgaataataggctaaaagaaattattgagaatttatcacaaagagcaaaaattcaaaaacaagaaagaggttcaaaactacactgtttcatgcacactggtgtatttatgatatatctcacaaaaatgtctaaaatataatcaaatatatggtcaaatatgctcattcatctttagagctttctataagaagaaaacaaaaggaaaaacattatgtgcaacagtaggggaaggatcagagagttaatagttcatccattacaaattatgttactataaatacttaacgtcatgagggaaatatttaccttaagagtattacatttatacattgatctcaaattcaaagaatagtaagatatgttatttatttaacgatacatataaaaagaaagaatatcttatttaatagtagagcttacttctgaatactagggatacaggtactttaaaattttctttgtaggctctttgtatttcccagttgttttaaactgaacatttagtacttaaaaaaaaaaaaagccagaaagctgctaataagtattaaaaagtggtacttagtgatgtattctagaacttttctgtgctatatctgtgcttttcctgtggtaagtgcttatcatatttttaaaatgactgatatttggctcttatagattcttaatgtatatttaaatgaagtggatgaataataaaagttagtggaaaatttataaagagtaaggccttgaatatttgcaacacactgaactgttgattactggggatttaagctgagagtcttcatttaggtgcaatttagtaagtgtcttagttccttttgtgctgttataacagaataccagagattaggtaatttataaagaaaaaatttatttcttacagttctggaaagccgggaagtccagtatcaaggtgctagcatctggtgagggccttcttgtggcatctcatggcagaaggaagaagggcaagagagcatgtgtgtgagagaggaagaaattaaacttgcagcttcaagcccttttataattgacattaatccattcatgagggtggagtcctcatgtcctaaacacatcccatcaggtcccagctcccaacattagggattcagtttccaacacatgctttttggggaacacattcaaactatagcagtaagcaactttgaagacgttcttgatttgcttattcaatatgtgtaagatctagcaatatttatgagataaatataatatgcaaataattttgttttaatttattcatatgataaatatttattgaatgtcttttgtgtgctacacgttgcactagattttggagatgacttgtgaaaccatatacagtctttgatgagatttagagcatagtagaggatatatatgtatgtatgttacatgcatatatgatttattcaggagtataaggcaattcaatattaggaagtccattaatataaaaggttgggggaaatgtggagagtaataccagagacaaacaactataaaagacatgtaagttgttgtctttgggcagaatcactatgaaatgatggttggataggtggcagctgttgttacatcatatatattttatcactgtcttatgttttcaagtttgtacatatgttactttactaaaaataaaagttaattttctagctgacatcaaattatttcttcctctcaagtcctttgtagctactgtcaccagcagaatatcccatagcctccttctaatatctcctcaccctggcagcctctgatacagggataaagtcctttgagttggctttggctcagttaccttcagtattgtccaattgattcatgataaaaacccgttgtctttatcatgctaaatgaccaaagtgtaaacttccaccttactgtcctttctccttgccttgctatcttcattggttccagtgagtctttcttttttagtcctcttgagcaaaaacaagcttttccacaattccaagggatacatgtcaaacgctcagaatgctttattgaacgctcttccttgacaccatctccctaaaaatgtcaaaacactctaacaacacttttccaaaaggaactcttttgccttgttagatttcaacattcttatatcccccagggtggtgtcacaagtgtcaaaaacagttttgagtctcattgtttacagttccttcatagacaatataataaatacctcactttggccttaacattctgatacatgttaattgttacactattttatccattataaagcataccacaaaattagaaactaaagagaattagattttttatgtatatatatatgatatcttcttttaatggataattatgcacattcctagtatgtgtgcagtttgatttggagaccattatattgaagattccgtcctgtttgggcaggattgcatatgcccctgagcctatatagctcttgttatagaaatttattgtgttgatttttttcactgttcaatatcccacccccatagtagaattgatttttagaagaaacggtgacagtttttagcagccatgatggtggcctagggttgaagaaatatgtgatgtattgttagagtccaagccatgctgttctattaaaatactatttttcttcctgctctttttgaagttgattttatttctgcttattttctaagcctgaatttctggccttcatttgtttttgttcttcttgtttttgtttttgttttgttttgtttttgagacggagtctcgctctgtcacccaggctggagtgcagtggcgcgatctctgcttactgcaagcccggccttctgggttcacgccattctcctgcctcagcctcccgagtagttgggaccacaggcgcacaccgccatgcttggctaatttttttttgtatttttagtagagacggggtttcaccatgttagccaggatgcatttctttttttttaatacttaagtttctttttcttgtttaagaaagttggagttaggactgttgttcattcacaacaaattgacaccactgccttaatatcataaagactctgtattgtttcagttgtttgctcattgggaaaatactccagggtgaggcctcccttacatctgagggacctgattccctgtgtagagagttctttttttttttaattgttccagtttatacttctggtagacttttaatcttcccccccactttaaagtcccagtatgccccactataaattgaaacattgtgttctagtctttatctacaaacttagagaaaattaattacttttcaaggtaacatattcaattttattttcttttttcttagatcactccagtatatccagcaaactcccttaaactaagcccaaactggtgttgttgcctgttgcaatttccttcactagagcatccagaaaagcttacttgcctttgcatataaaatctcttactttgggaggccgaggcgggcggatcacgaggtgaggagatcgagaccatcctggctaacacggtgaagccccttctctagtaaaaaaaaatacaaaaaaaattagccaggcgtggtggctggtgcctgcagtcccagctacttgggaggctgaggcgggagaatggcgtggaaacgggaggcggtgcttgcagtgagcggagatcgcgccactgcactccagcctggacgacagagcgagactccatctcaaaaaacaacaacaacaacaaaaaaactctttaattgctttaaaacagctaaccaagtcttatttcctttatcttcttgtatttttcttatattaccttggcaaaatgaaaaatttggggatttagtgtttgccaagtcaccatatggataaatcaccactagtgaagaataaactatatccatattatgttactttaaatgaaacgattacatttcatcattaccctcagaattaaacctgttatttacactactacttctcatcctttcttctaataggctccaagctttctcctttttcatctttcatctatcccaataaaaacataacttccaattttaattagaatagctatatataataggttgaccaactgtgtatcttctgtagccttctgcctataacctgattataaaattgctttaactaaagtaagttactgcctattctgagttactctattacacaaaatttaattttattacgctactttcttttccatattattttcctcctagcctcttccaattctttgtcttcttgatctcccttattaatccttttctcagggaaggaagatctgatcagccaattcactccaagatttaagtgactagtggttggaaatctgttcctcttcagcattacctgtaatttaaacaaggaattaagttgtattggctttggtgaggcacaacgtgtgtttgtatatgagaatgagttctttatagcacccattcagtcacacaaggctacctacttgtaagtctaatgtttagagtaaacagtgaattatctaatacattttgcatttcttacaccttgaaagaatgttgataaatttccttatacaagtagtctgatctgatgttagacaaatagtgaatactcagttttattgattaattgagtgcattttcagaatactgaaagattaggaattgtggttgactgagcattttgttaagatgttattagagacaaatacaaaaaaattctggctctctggattggactctgtgtagattgattccatctgtaaaaggtgcctcatctttgacagtagatattttagtcactgttacttgttagagattcaatatagcaatgcaatttttttttatttacttataaggatttatgataccaagttgtatttgacatttggattaaatcctgaggggtaaggaagattcgtccctgtggtagaagtttctaaagtcttaagtcaaatgaattctacttacactttagttagaaggccatttaagacaaacgtgccttaaaagatcaagtttttcagtgttaaaattctacatctcaatataggttatgaatactacattaagttcatttggttatgaattcattattttcaccttttgctgctattgttatacttcaactctcttatttttacaactttttattttgaaaactttcaaactttaaaaaaatgttgggacaacagtataatgaacagctgcactctgcacacctagattctcatgattgagaatacatgctgtatctatttatatctctgtcttgccttctctctatatataacttaaaaactgtttcagacatagtgacactttacccctgaatacttcagcatgtttccctaaaattaaggacattgttcaccgtactcttatcatatgctggaaatgttaacattgagacaataatatcataaaatataacatacaaacctatttttagatttctccaattatctcaaaatattatttatagattttttgattcagtattctgtgagggattataaatgataatttgatagtgatatgtcttcaccattttgttatatattgtcagaaatttgatgtagaataattcatatgttagcaactgtggaaagtgttgccaattatgaaaaaaatgtaaatttagataatttagaaatagtccactaagacttttattatatagttgattatattaattaaagtaacttgaattccttgacagtttacttatgtataatgagtgttcatgatgccctaattgaatttttatttttttaaaatttaatttttaaaaataataataatacagtaaaaaaccctttgtgatctttcttaatagtcacatcatcactctaccctgcctatcacagatctgttttacatcactatagtttgtgtttttaagaatgtcaaataaatagaatcagaaagtatgaccagcttctctcagagtagagtctctgagatatatccaagttgtgtatgtcaataatttattcatttttatggtagatagtattccattgtacatatataccatagtttgtttatctactaacccattgaaagacatttgggttgcttccagcttttggctgtcacaaataaatctactgttaatatttgtatataagttttggtatgaacataagttttcatttctctataaatacccagatgtacaattgctggctcatatgataaatgtatacttaacattataaaaacccgccaaactgttttccaacatctgcatcatttcagtattaggctcaatcaattgtcttatcccatgtgaatttgtatcctgtattactttataagactctgagtcttatttagatcctgtggaaaatattgatatttttgttttggccttctgtggattgtgtggttctaaccttggctctattttacaagactttggtgtgcaatttggatctgtcatgaatgtgtaccctctagtggtcactctgggaccagcttgtagatctgttcttagctaaggcctttaaatatttgatatgctaattagtatcaaatccataaatgggcagatccagggtgagtaaaagttcaaaacaactttatgtagttgctttcctggtctcccttccctaagtactttctacttcccttggggctgttttttttgttattgttgttcttcaaaaaagaaattgtttctttctgcagttttacgacatcctcacaccatttagcactggtgataagatgccaccaaggctacatggtgggaagacagggacatagggaaaaaattctacagggtttggtgctgcccttttggcattgctgcttctctgaaaggtaggtcgacctccctcagagttttgactcctgcagtctctcatttctgtcttcttttattttagctgccatgggactgttcagggtttggggcatagaaaaatgaggaagaggagagggggaaacaaaataacctggagatttctcctactctttctctgtctgcactgtaagtgttcagaaaatttctcctggacctcactcacaccacatagtgctcagttctgggtttctggcttcagaggtagtggaggaaaataaatgttaaactcaacattggtattcttccctcatctgtctactagtgttaacttttcagagttttcagataagtctctagccaggttttttagttgaattagcatgagataaagagagtctggtcttatttcatcttactggaatcaggacccctaattgatttttaaatggtattgttgatacaattgtcaggccatttatttcagtatttcactaagtaacttctaaactgtgaaaaaagtaattataaaataaacatcaggtatttttgttcttatttgtatctttgacatgagataaagtttgtggaagatttaacaagaacatcataagaagttgactataaattagatgttaattcattaatttattcactccacagaaattaaacgagtactgactcttggcctgggattgcagatattataatgaacaagataggcagagctccttctcaggacgggttaatagatttgagacagtcatttatagtacattgtaaaaaaaaaaaacaaaactgccccagagttaatgttaaaaattgttttattattttttctttaagataaaacttttaaggggtcaggactctggtaatgttgaatgtacattaatgcatttatgtatggacatagctgaggattttgttaaaatgtgccttaaatgattacataaattaaataagcaatttgttcagcaggttaaaaggaagatatttcatatttttgtaaatgaacacatgaaattttttcctttaagattttaaatgccaaattatttacttaggtagtgaactatagtgttaacattaaataaaaagagatctacatatctactcctatttctgtattaataaactgtgatgatgtatcaataagtaggatcatgtgccattaggacttgaaataatggaatatggtacgtcctaaagcttattttgtcattcatctagccaataatattaattacttaatatcactgctcaagctatcatctttgagaaatactgatttaacaatagtttacactaaatatgtaaaaaataattttaaagtcaagcaaaccataggttaattaccccattacttgagaatgcaaaaaaaatacttttactatagtacttattaataaactcatttttaaatttaaattgcaaaagttatcacaggctttctatggtatatggaattataataacatacttttaattgatgtttgttggaattcacagcatttatagactttttaaatagactttattttttggcagttttaggttcatagcaaaattgagcagacagctcagagattttcccatataccccctgcacccttacatgcatagcctcccccattatcaacattctttaccagagtggtatatttgttgccattgaagctacattgacgtatcattattacccgatccatactttatagtaggattcactgttggtgttgtatattccatgggtgtggacaaatgtattatggcaccattatacaggttgaatatcccttatccaaaatgtttgagaccaaattgtttctgattttggattttggaatatgtgtatatatgtagtgagagatattagagatgggacccaaatctaaacattaaatttatttatgtttcatctacacatggcctcaaggtaattttatccaatattttaaataattttaggcatgaagcaaagtttgcctaaaacgaactataagaaagcaaagatgtcaagtgtggaattttccacttgtagtgtcatgttggtgcttaaagtttttcaggttttggagcatttcagatttcagattttcagcttcagaatactcaaactgtagtataatctagagtagttccactgccctaaaaatcctctgtattctacctattcatccctttctcctcacaagccaccagcaaccatggatatttttaatgtctctatagttttgctttttccaaaatgtcatatagttggattcttatagtgtgtgtccttttcagataggcttcttttagttagtaatatgtgtttaagtttcctccatgtcttttcatggtttgatagcttatttctttttaccattgagcaaaaagaaatgagttgtttatcatccactcacctactgaaggacatcttcgttgtttacaagttttggccattatgaataaagtctgtataaatatccacatacaggcttttgtgtggacatagttttcaattcctttgagtaaataccatggattatgattgctgcatcatgtggtacagtgtgtttagttttgtaagaaaccaccagactgtcttccaaagtagctataccattttgcattctcaccagcaataaatgagacttcttgttgtttcacattcttgccagcctttggtattatcagtgttctgaatattgaacattctaataggcttatagtcatatctccttgttttattaatttgcattttactgatgatatatgatgtggagtatcttttcacattattatttgtcatctgtgtatcttctttggtgatgtgtttgttaaggtccttggctcatttttcaatagagttgttcattttcttattgttgagttttaaaatctctttgtatattttgtataacaattcattatcagatttgccatttgaaaatattttcttccagtctgtggcttgtcttttcgttcccttcacagtgccttttacaaagcagggttttttttttaatttttaatttttgtgagcatatagtaggtctgtgtatttgtaggattcatgagatatttagatataggcatacaatgcgtaattgtcacatcagggtaaatggagtatccatcacctcatgcatttatcctttctttgtgttacaaacaatccatttatactcttttagttatttttatatgtacaataaattactgttgactatagtcacccagttttgctgtcaacagagttgttaattttaatgaaatctaacctactgtttctttcttccaaggatgttgcctttgctgtcatatctaaaaagttattaccaacccaaggtcatctaaatattcttctattctaggagttttatatttttatgttttacatttaggtctgattcattttgaattaatttttgtgaaggctgtcaggtctgtgtttagattcattttttttgcacatcatgtcttttaagattctgagttctttcggaagacattccttggctgggattccaattttggctctgcaaggacatatcactactctcatactaaaaatcagacttataattgtagtctctgttttccaagtcaggaaataaggaaaggaccaggacaccagtagtagccatggtcttaaggctccaaaaagatgtagagaggaaaatacataaatacattaacttagtggaggtgagggaggaggatgaccttggtgccccctcacttttttaagcacaggtaaagttgattcataataatgtcaacatgtacttctttaattttttggtagcaggaaaaaggtaaattaaagcttaccaatgttttgtaaaattctaagtatcactggccctcttgtattttatcaatgctgaaaatgtgatgcttgaatccaaaaacaaatgaaatcaaggtttgattaaaccggttctaagacttcattactttgctacttctgacttactgccacatattactattactcctaattgtactaggttgctttggtttggattccagcaaacgaggtaagttggcacaagtgacctaaaaataaagtttttgtactgctgggatatcatttggctggttttctaattttgttgggcttggatcagaattaattatgtgttattttcatatcaatgtcaagtctgtatttatagcattctttttttttagaagtcacagaatttttaaaagtagcagaaaaacaataaatgatattgaaaaaattttagtacttacattttcgtcatgatcttctaaagcctcctaaaagaaacattgctcttgtgaatggtgctgcagtgaacctacacattcacgtgtctttataatagaatgatttatattactttggatatatacccaataatgggattgctgggttgaatggtatttctgtctccacgtctttgtggaatcaccacactgtctttcagaatggttgaaccaattatattcccactaacagtctataagcattctgttttctctgcaacctcaccagcatctgttatttttggactttttaatagccattctgatggctatgagatgatatttcattgtggtttttatttgcatttctccaatgatcagtgatgttgagcttttgtttatatgcttgttggctgcatgtatgtcttcttttgagaagtgtctgttcatgtcgtttgcccacttattaatggggttgtttggatttttcttttaaatttgtttaagttccttatagatgctggatactagacttttgtcagatgcatagtttgcaaaaattttctcccgttctgtaggttgtctgtttattctgttgatagtttcttttgctgtgcagaaactctccatttgtagagccctgcaggatagatttagcataattcttgaagaccctagtattttcagaatggtcaatgagcattggcttcaacttaaagtcactagctgcactagtccctaccaagagagtcaacctgtcctgtgaagctttgaagccaggcattgacttttcctctctctatgtgaaagtcctagatggtatcttcttccagtatttaaggttgtcttatctacattgaaattctgttatatagaatagccaccttcatcaatgatcttagctagatcttctggataacttactgcagcttctacactagcacttgctgctttacctcgtatgtttttgttacagatatagcttcttaaacctcatgaagcaacttctgctagcttccaacttttcttctgcagtttcctcacctctctcagccttcatagaatcgaagagaattagggccttgttctgaattaggctttggcttaaggaaatgttgtggcttctatcaagaccactcagactttctccatattagcaataaggctttctctctcttgtcatttgtgtattcactggagtagcacttttaatttttttcaaaaactttccctttgtatgcactacttggctttttgccataagagaaggttatctcagcttttgacatgctttcttctctagcttattcatttctagcttttgatttaaagtgagagatatgtgactcttcctttcacttgaatagaaaccactgtagggttattaattggcctaacgatgttgtttctcaaggaataaggagacccaagaagagggagagagacaggaaaatggccagctggtcgagcagtcagaacacacacatttactgattaagtcccctgtcttatatgggctcaattgatgttgactccaaacaattacaagagtaatatcaaaggttaattattacagtttacaatagcagacatgatattaatgaaaaagttttaaatactacgagaattactaaaacgtgacacagacgtgaagtgagcacatgcacttggaaaaatggccccagcagacttccttgacatgggttgccagaaaccttcaggttgtgaaaagcacaataaagcgaagcacaataaaaaaatgtgtttcttaaacaacaagactataatggacaagaaagagctgagactagagacaggagaccaacatgttaatcttaagtcaggaatcctaaagtgaagcaataggagtggttaaaaaaaaaaaaaaaagagaagagagattgatttaataaataattgtaatatagaattagtagcattgaatcctgatacacccacagaaaatatatacaaacgtgtttaaataatgaaaatttatggtagattctgttattggccctgattttcaaccatgtccgtcaaagccctttgccatataattttttaggaacccactgttgggggtggagtggacttccttgccttatgaatttgtatttgaccacttaacttgttgttaccaatggatagagcccctgggtatatacttactctcttgtacatccaccatgcaataagaatatgtgtgacagtattttggtgtcaggagaaggatgagagatacatgggggagagctactcccaggcctggaccagataattcttcagttagccatgtactcatgaatgaacccagctgagcccagcctggagcagccattttttaagcagtgcacagatttaggataaataataagttatgattgttttaagcccctgagttttagggtggcagtcatagctaactgatataaagtttctattctgccaaaaaaaaaaaattttaaagaaagttatattctattctattttcacacatcaattgatgtgaaaacaaaatataatctactgatccaacaggaaaactgcttgcattattggttttatttattagactgccttaatgcagcaatcacgcagctagaaagggaaaaataaaacgaatataatttataaaaatagctttattgagatataccttatatatcataaaatttacttattttaagtgcacaattcagtgatttttagtatacttatttttgccactgtcaccacaatgtaatttcaaacatttccatcatcccaaaagaaatctctgtgcccattaccagtcactttttttctctcccacctccagcttaagactatgtaaccacaaatctacttcctatcactatagatttgcctattctagacttttcatagcaatagaattatacaacatatagggatttttgtgtttagcttttttcactgagcattttttaaggtgcttctatattgaagcatgttttagtagttcttttttatttctggatagtaatccattatctgagtttatcacattttgtttatttattcatcagttaatggatatttgagttttccactttttgtctattatcaataatggtatgaacattcatttacaagtgtttgtacaaacattatgtttttatttctcttagataagtacttagttgtagtagaatttctgggtcatatggtgactctgtcttcagcattctgagaaacttaaagttttccaaagtgactgtgccattttacactcccaccagaaatttatgagggaaaactgatagtaatttaattatactgaatattcaatttatactactagtgactttcatatcataatacagaatgataactatatataaaagataataatcagataatctgaaaataataaaactgtgaaatgtacttctctctatagtgagtcatatgtgtaagttatgcagcaggtgaagaaatgtgtaagataggccttttaaaacacaatcttaaatcttattaaggttttctagagtaatataaataatgcgataatagaaataagatctacttattttctactattctgtaaaattattaaataattaaattttctttctatagtaatcttgttacaccaagctcactttgtactattgtgcctatacagaaattacactaatttttcctccattaaaacattaaaatagccttttgacttttatagacttcagagaagttgtcattatatctcaagtgctatgaatgtgaactgtgggaatgtgaactttactaagaatcaattatatagcctaagttggtgttttatatttgtttttcctgcactgttatggaaacctgtaaaatatgttaacattgaactatttggtcttatttagacagtattttatcttacaatgctgtatgatgaaatcctgcactcaaataaaacattaatcagcagaacttaaataaaaatatatgactgttaattttgtagtcttcctacttgcttagaaattaaatttctaataaatctttgtctctgattttgtgcaaaacaatgctattggctggtgacttcactgtctaagaatatggatttataaaggtatagagagtatcggttatatagaggtatcaggtaaagttcatgcaagccaaatatttttaagcattcaatggtgttttcttgtaggaattaaatgtatttattagcttgactttactgactatgtttgcttaatattaatctattagagcataactgcataacatgggttttaaatgaagcttgctgttactctaaatttatgtcacaaatgtggctctgggaaatttttcaagtttgtctcagtgctttaagccttataaaaatgagcaagtaactcataaataatagacagttcctcagaagtcatttaaagtgcactccttttattggcaaaatttccatatgttctttggctctttgagatgtagactctgtagagctatttaactaccattattttctggtgatttttttcaggtacctttctttatgatttatggttctgtaaaatcttacctcagtgtgtagctagaattatttagtcacatatttttaaataattttaaaatttcgtaaaaattcctgtgacccatgaacatcatcaaccaatgttatgagataaaatacttccctccccaaattagaatgcttttctttcatatatttcaagcgtgagtcagaattggaaaggtactaatttaaatgcattgtgctttctctaaagtggacaaaaggaaaataatagttaataagagagctttctagcatggtaccaaataaatatttgggctggtgaatgagcaagagaagtacaacaatccacttgtcctgactttcaagagttttctccttgccaacttatcacatttgtaattaattaatatttgtgcatttatctgcttaatgtcttcctctctttattataagttgtataaacacaaagattgtctatcttattctctcctttacctctaaccccaggatattgtggggcacatggtagaagttgctcaaaaaagtttttgttgaatatattcatgaatttgaatgttttgccctacaaattaactttaaaagtacttatggagtacatgccgatttaatatacctataataaatatgaatattcattgcatgtgtacatgtcaatatttaacagctatcatttatttaatgctttttttcaactttacaaagtgccctaacatatttttttaaatgtttgttgctcacagtaatcctgtgaggcatatgatgatattgctgtcattcctccatatccacaggtttcttatctaaacctgtggttgtgtaggcaggggcacaactgtgctttgcatccacagatgtggagggccaacagaactcgagcatcctctgcattttgtatccacggtggtcctggaaccaatcctccatggatatggagagtcaactgcatttccattttataggcaagcaatatggagtttagattaaaaaaaattgtttgctccaagaacacataagtttttaagtgatcaatcctggacttgaatcatttgtttttactgtcttttggatggcaacattaactttgtaccatatacctagttcttcattaattaagagatggttacaaaattaagatacatataattgtcataagatcctcaaataaataaatgctttcagttattttacatgtgctgagaatagtagtcacctttgataatgagaatgaagtataataaatctaggttatgatgtttatttaagtctgaatcatgtaaaacagaacaggcatacttctaaactaattctgttagacagaaatagaaatccctgacaattaatgaagtagcacatagtggtctttgaattacctgaattagttattttcttacatatgccacagatacttgagttcagctcattaaattttctattatttcattaaaaccaatgcagttagcggtaataggggagtgaaaggagaaggaaattgtgtagagcaagatactttatttgagagtggttatgtatgaggtggaggtggggaatccaggaaaaccatggagttatgaaaaaattaaaactcattggtatattttatttgaactaaagttgatacaatctccaagaactagaagtatttattacataaaatcatctttttcaaaagtatatgtaaaccttaattgctgtcagaaaaatatgcacaatagtgtgtatacttgcattaaaaagggatatatatatatatacacgcacacacacacacacaaatataaatgggagatataagtgcaattgcatttattgattgattgagaccaattctcactctgtcacccaggctggagtgctgtggcactatctcagctcagtgcagcctccacctcctgggttcaagcgattctcctgccttagcctcccgagtagctgggataacaagcgcgtaccaccctgtccagctaacttttgtatttttagtagagacagggtttcaccatgttggccaggctggtctcaaactcctggcctcaagtaatctgcccacctcagcctcccaaagtgttgggattacaggcgtgagccaccacacctggctgcaattgcttttatatgcatagagggacacataaaaatctggttggcagggtagggaggaaaactttttactgtatgcacttccctaacattatagttatttttaccatgtgaatgtgttgtggtctttctgctccttaattcagctaggtccaagtctttttctcacaaccaggaagaattaggcaggcatgtggacactgtacagtgagtggaatagaatttattaagtgaaaggaaaaattctcagccaagaggggatgtggtggggaggggtgtttcccccacccaaaggtgggaaaattccccgtgtagctggtcctgggccttttatggacttagaatggggagtatgtgctgattggtttgtgattatgcaaaaaaggttaaagtgaagacaccactcaaaggtgggcacgacagtgtagaaaaccaattaggaaagggtaggtatatataaagtaggtgaaggtggggatcagtcagaggaaaggctgccacacaggaagacaagttatcgatccagtccaaaggttaaacttgtagcttggctttcaggctttaaactgtctttggcttgaaagtgggatttcacaggggacccaccccctatctgcctaggcatttggctgcctcctatcactctaattttccccctctgaaaaggtacctctaactgccattagaataggaatgaagacgatcttaactgctttctgctgatagagggcactgtttggggaaaatagcagtcaaatctccctcagaggcttgtctaaggatccccagtaaaagggagccatcgtttgaagctacagttgcgtgaccattttgagtttgatggcctgaaggcgagaagagagaaactgggttattagaagacatgtatcaaaatgaaaaaagggggtaaggacagcttagaaatcctgaggctgccaccatgccaggataactggtggctgtagttgtacctgctaaggtttgggtgcatggggcttggctttggttagctcccttggccttattttcccaaagaaacctccgggttatgggtaccccatttatttctatcacctggcaggatttgcaggataattgcccagaactagaatattgatccagaattttactttacccatccctctgtttcttgtgagctgcagccagagaccactgtttggttcacagggttagtctaaaacgtaggcaaaaacttaaaaacaaataatgagattagaatttaatggcaagtgtatgataagttttgaaacataatttttctctctctagtcctcatttttgtcaaaaacaaatcatgataggactgagttgtttgcaaaataaattttaatcttatacttggcttgaatatttgcataaagtgcagcaagaataattatttttcacgtaggcttttaaaattggctttgatggaactctgttccacaaggaatctcagataagactttcttaaagccgagcccagccatgggtttctaccctcaaatgcctgtgatttgggtaaattccactcttgaggtcccaagataacttggggttcctgggtctattagaaagtgacattctttactcaccacaggttaggaaccctgtatagggactgtgtagacaaggtatgaggccagttttcccaaggggctctgcaagtcaaacttgactccttaaaggaaggcataaccttctactcaaagccttggtaaaacaaccagtttctctaattgtgtcctgttgcaaaagaaaatggattcttattgcactgatgcaaataacaatattaccataagttaaacatacttactgttgttggtttaaagtcttttttatctgaggtaagaatagcaacccctgctcttttttgttttccatttgcatagtatttctccagctctttactttaagcctgttggtgtaacgtgaaatgggtctgttgaagatagcagagggatgaatctggttttattatccaacttgcaactctgttacttttaagtgcagcatttagactgtttacattcaaggttaatattgatatatgaggctgctttgatcatatggtgaagttgttagctggttgttttgtagtttccattgtgtgactgctttatagggtctgtgcactgtatacataagtgaaatatgtaatataactaattaaaatcaaatattgaaaatttaaattagagaaacttctgaattatagtttttgtatatttttagaatagatttattattttacatgtatacaattactaagataatcacaggcctctgtttaaattattgctttctcagaggttaaatagcaccacccaatctaaagttgttttcatgcattatgtcacatcatcctctttataatgttttctttacagcacttacaatatttgaaattttctacttattcatttactacccatttcccccggtagaatgtaagatccatgaatacaattactatatgtgttttgttaactttctatctagcacatgaaataatgcctagcacataataagttctcagtgaatattcagtgaaagaacaaaagtgtttagaagtattattttaataaatagataaaattttagtagtgtatcaagagtctttataatctttagagagccacagtgtttcttgtgtagtttaaaaattactctgtaatctcatttaattatgttttgcacgctttgtatattgtaagaggttaatttatatgaggtctgtcaaattgtcatataatctataagtttttaatgaatgtttattgtatccatattatatgaaataattacaatgggttggtgggggcccacgcgggttcaacatgcatatcgagaagtgttatttctgttcagggcccatctaccctggccacagcatgatgttcatccacaatgattgcaaggtgttcagattttgtaaatctaaatgttataaaaacgttaaaaagaagcataatcctcgcaaagttaggtgaaccaaagcattccataaagcagctggcaaagcacttatagtggataattcatttgaatttgaaaaacatagaaatgaacctatcaaatacagagagagctatggaataaaagtattgatgcaatgaagagagttgaagagatcaagcagaaatgccaagcgaaatttataatgaacagattgaagaaaaagagcgacagaaagttcaggatatcaaagaagtcaagcaaaacatccatcttatccgagcctcttttgcaggcaaagggaagcagttggaagagaaaatggtatagcagttaccagaggatgtggatatggaagatgcttcttaaaaatctctgtaaccatttcttttatgtatatttgaagatgccctttggagacttggaactgctaaattattagtttattttttacataggtcacttaaatgaaaagtgattaatatatctttcctacatttccatctacaaaacatcagatattacggatattagattgcatctcagtgctaaattttcactgatagatatacttaatgtaaatcatgaaaattctacttataactatagaagtgaattgtggatgtaaaatggttatgccatttggataatggcactaggcagcatttgtataataactagtgacaaaaattcatggctagtgataaaatattatttacagtaaaatattccctttattaatattatagaaggggggatacaacaagaaactaacaatttgtatgacagtgtcaaatattattttgattttagtacttcctgttttcgtttatttgcatcttagaagagcataatgacattgtttgatgaagcttaattatgctgcactgctttgacctggtttaacccttctgataggtagttgtggatgttggggatgagaactgaataatctttgcctggagtgacactacactctagaatttccactttggagaaatactcagttcttttttttttttttttttgagatggagtctctttctgtggcccaggctggagtgtagtggcgtgatcttggctcactgcaagctccgcctcctgggttcacgccattctcctgccttagcctccccagtagctgggactacaggcacccaccaccactcccagctaatttctttgtatttttagtagagactgggtttcaccgtgttagccaggatggtcttgatctcctgacctcgtgatccacccgtctcggccttccagagtactggggagaatactcagttttaacttgcgattcctggtagagcatactttatttttctagcctagcaatgatgtagaagcagaggaatcccagtgccttttaaaagttattatgtggttttcttttaaaaagctcctgtttttggaaagtagaatttatgggtacgccatctgttcattatttgcacataaaataaaaccttttgaaaggttaaaaaaaaaaaagaattacaatggaattttactagtgttcattaaaaatatgaccactaaataaaactgcaaataagagaaatggcatatttctaaataaaggcttctaattaatatactaattaccaatggttcatgtcagaatgttaaagctcttgaaagatttcctaatttgcttctttgtaaactactttctctttaagaattatgtaaggcataataatacaaactgattatattccactggccaacctatgtgaaagttctttaaaatgaggaatatattatggtcgatatctttaatgataattacctttccatggtgtaaaatctgaagaacaatcttgtctttatgacagcatttatatatgaaaatttaattctaagaaatatatggatttgcagagaagtgtcacatagtaaaaaaaaaaaaaaaaaaatctgggctctgggatgacattgttctaagtagcagactgttttctgttcataaccttgagcaagttaacttttctgaacctcaggtatagtgctgaaacagtatatgtaaaaatgcctaacacaatgcctattagaaatgctcagtagattctaattctcttttcttcccgagtaaagtggaagcaaagactcttctcaaaagtatggtggccacatttaccaaaatagtagaaaaaaagaatggtgaggtaaaaaggtacccatttaacctcactaaggatgactgtatttaccagtgttaaacaggggagtttctaatcaaaggcttttaggaatcaattttgaccatattttaaaacaatagctacatttattttccaaaattattttggtctttaagtcatagattatatggtaatataaatcagaatgtcttctatcttcaattttggctaaaggcaaatagtaatacctaatacttatttacatgcatactatatactgtcagccgtccacatctgtgggttcctccacatccatgggctccacatctgtgaattcaaacaactgcagttcaaaaatatttagagaaagacaataaaagtaataaaaaataccatattacaactattttttttttaatctttttttttttttctttttttattattattattatactttaagttttagggtacatgtgcacattgtgcaggttagttacatatgtatacatgtgccatgctggtgcactgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaataggcggtgtttggttttttgttcttgcgatggtttactgagaatgatggtttccaatttcatccatgtccctacaaaggacatgaactcatcattttttatggctgcatagtattccatggtgtatatgtgccacattttcttaatccagtctatcattgttggacattttatataatattcatattgtattaggtatcatgagtaatctagagatgatttcaagcagggttccccaaaccctgggccattgaacagtagtggtccatggctggttgggaaccaggtcacacagcaggacgtgagcggcagacgtgagcaaaacttcatctgtatttacaaccactcccattaccgcctgagctccaccttttgtcagatcagtggcagcattagattctcatagaagcacaaaccctattgtgaactgcacatgtgagggacctacattgtgtgcgccttatgagaatcgaatgcctgaagatctgccactgtctcccatcacccccagatgggactgtctagctgcagcaaaacaagctcagggttcccactgattttacattgtgatgacatgtataattattgcattatatattacaatgtaataagaatagaaataacgtgcacaataaatgtaatgcatttgaatcatcacaaaaccatgcccccaaccccccaatccttggaaaaattgtcttccatgaaaccagttcctggtgccaaaaagtttgggaaccactgatttaaagtatatgatgggaggatgttcgtgggtcacacacaaatactgtgtctttctatataagggacttgagcattagtgtatgttgttatctgcagggggagggaaggtgttctgaaaccagtccctcaaggatacccagggaggactgtaccaagtactgttctgtaaacttggcctagattaactcatatagttaatcctatatggtaggtttttttttttaatcattttacggatcaggaaactgatgcaagatgaattaagaaaacgtgcctaaacttacacaacaaatacgtgccaggtcagggctgagattctgatctaggtaaactgactctagattttatgcttttaattttcacacagtattctgagataaatccagagaagtggtacaaacttgaaacaggtctaaaaagttaagcacagaatggattgagacctttaaaaagctgaaggaaaaatatagagaataacttctgtagctatatatcatcaagaaaaatcagtaaatctattgtatagaaataatagcacaaatttaaaatataaagataatataattacttattgtacatgattagtattctaagtttaaaatataataaaaattaaagaattacttgactttttaaaaacttttttcttttgccctcctgtgaggacagtcattattattttaaaaaagaagataatcatatttaatagttaagcatgtatgcacttagttgctttaaatgatttaaaaatactatcaacctgaactactatatatccagataataaaaaaatgaaaaataacatgtgatgtcagaaccactgttaatcttttagaaatctgttgattatctttgagtaaaaagaacagaagggtgaaccttgattgaccacttcccattctttctgatgtgagagggtatctcaagtcaaaaaagaacaggtactgacaaggttgcacagaaaagggaacacttattcactgctgatgggagtgtaaattaatttgcccattgtgaaaagcagtgtggcaatatttgaaagaaaaaaacagaattaccatttgacccagcaattccattattggatacataaccaaaggaatataaattcttctgccataaacacacatgtatatgtaagttcattgcagtactattgacaataacaaagacatggaatcatttaaatgcccatcagtggtagactggataaaggaatgagagcatgtcttttgcagcagcctttggagccagaggctattatgttaagtgaactaatgcaggaacagaaaaccaaatgccgtatgttctcacttataagtggaaaacatggagtacacatggattcaaagacaggagcaacagacagtggggcctacttgagggtagagggtgggaggagggagtggaacgaaaaactacctattgggtactctgcgtattacctgggtgacaaaataatctgtacaccaaactcccatgacgcacaatttacctatatgacaaacctgcacatgtactactgaaacagaaaaaaaaaagaatgactgaatgtacactatgatggaaaagctgtataatttattatctacatatagtcatctatttagaatgaaatatatatctggataattaacttcagctgatatgtactagttcttcatttcaatctttcttattcaggaattgattaaatagagactccagttccacctgtggtggagtagcttctatgaaaactagctagaatacataaaacaattgtttgaaggaattggagaacaaccagtttaagcaggacttgagggataatggttcttgggagaacagaatagaagcactggaaatgaactccacatttaccctaactttttccctgagagcatttttcaattcctagtgtggaagactggaatccaagtggaaaatgacaatctttctgtcattagccaactttagccagctcttaagatgcatatgtatatgtacaagttgaaattccaggaaattcatcaataaacagaatttgagtgtctgaacaagttagcagagatttcaggaggtgcatgggactaagaagaaaggctgaattttaagccctgccaaggcagaagggccttggtaaacttagttggaaccctagaaggactacactttaggagtgaaggcaaaatactgaaaaaaagagaaaaactatagttttagatatttactagttactcattgcatttagatatattgaatgaaacactagactcacaaaaacagtaaatgaacagacagttcattagaaaatgccacattgaaatacacacagaaaaatgaaaggtaaaaccaaaggaacctaagatacgtatggcacatggtaaaaataactgacatttgtgcaatattcccaaaagaaggatggatagacagaatgatatagaaacaatatttgaaaaaatactgattgagaattttgtaaaattgaaagcatcaaagcaaaaatttaggaagcaagataaattttatatgcacatgtgtttgtatatgtatatatacacatacatacatatgtgcaaacacacacaaagccaggtatactgtagtcaagctgctgcaaaacaaagaaaaaatttcattaatcttgcctctgcttccagtctttttagaacagtgattttaccaactatagttttctttcctaagtccattatttccccccatttttaaaaaaacttagcgtccctgttgatggctttcaatatagttagcttctcaacttccttggtcctaatcctctcctcaaattccacctttgtctttataagtagagttacttcatataagcttttaatttttcaaactatgtgttgaaaaagaaaagtaatatgaaagaaaagatttatttaaaatatttcaagatgcctattacgcatttctactcattatattcactctctgtagtaagtatataagactaaagacttgaatctataattcccttagttagtcccctcagacttctaatgggaagaggctccctaggacttctaaggaaggacaatgggctgtccttcccctgaatttctttaatttttacattgctagtcactagccctgtatatctttccctggtactttttcagtttctaatccaggctgccaaggagtactagagagattatcatcctttctatttgttctattgcagactcgctttttgaacagaaaaaaaaaaaaaaaaagaaaagagggaaaatgaagagtgaaaatagtgaataattctgggattgagcctagagaagtagaaagtgttttatcagtaacttctgtcttcttagtaagacagagggcaaatttatctgatatgggtatgtgttataagcttagggggaaaatggaaatttggaattgctatcagaatacatagagtaattgctttcagaataaacggaatagttgctactcatgccagtagatgtgtgagccagctacaaagataatcagaagagttgtcaagtatcagtcatgtccaagccacagttaaatagcatacatttataataaattatatcactgattcccagcaacatacaacaatgtttgtatgtagtaagtgttcaaaggattattaaataattgcagttatcaatagtgtatctgagatgactaaacagactaaagaagagaatacttgcacatatcaggaaaagatctaatagtcataatgaatagtgttttacgaattgccaacaaaagttcaaaacaatataaataatagtacacaaatgaaaattattcataaatatatggatctatttgaagaatttggagataactcagaggaaaacctctaaaatatacaaagatttagaaaatcaaatttatgaggaagattaaagttaactgggaatttttaagttactaaagataaaactgagtaatgatctaaccaactagtatacagagttggtatatatggagaggagtatggccatctgtttggtatatacatgcaagacagagcaaaataacatcaatataaattgcaaaatgagggagttttaaaattatttatcctaatggaaaaaaagtatatggcatgagaaattagaatagattaccagatgattatagagaagataatctctcttttaagttattgaaaactaaaattgatttttaaaaattctatttcatacctgctttattctaaacactaggccaagttttggaacacagaaatgaatagctgacactattcctgacttttcaatattctgcaggaaaagagctatatgagcagtgactttgaaagcaggactttttatgatgataaaaggatcaatccattaggcatacatgacaattataaacatacatgtacccaaaaacagagtttcaaaatacattaagcaaaaactggcagaattaaagggacagacagacaattaaacaataatagttgggggctttagtaccccactttcaataatggatagaacaactttgcagaagaggaagacattatagtccagagttatacagtaaaaccatagaaataggtactcagtaaaggtagaatataggagtttatttctaagcattcatggggtgaaggatgcattaagggaatagaagatgaatgtttgaaacaactcaagataattgactagtcgtctagattttaaaagatacgtatactatatatataatatacatatatacttgtctgctaggatcattagagaagaacattttagacagtgtgtagaaaaatgtggatatgtgtaaaaatttgtatctttgggcagctatttgtgactttgaattgttgaaactttaataagtatactgaagtggaataagggacgattgtaatactgggacatgaggctgaagaggtatgattctgtctcaagacagtgaagcatatagataatgctagagtacctacaataattaccaatcatctatgaaatataccaaattttaattctaatctttcacttcttaaagtgtatgttagtcaggatcttatctgatatagttttaaaaagtatttttaaatatttgagcctatgtagagtttttaaaaattatgttaccttttttaacttttattttatgttcaagggtacatgttcagatttgttatacaggtaaactcatgtcataggggtttgttgtacagattattttgtcacccaggtattaagcctagtacccattaattatttttcttgatcctctccctcctcccgtcttccaccctccaatagaccccggtgtgtgttgttcccttctatgtgttcatgtgttctcatcatttagctcctgcttataaattagaacatgtggtatttggctttctgttcttgcattagttcacttaagataatggcctccagctccatccaagtccctgcaaaggacattatcttgttcttttttgtggctgcatagtatttcatggtgtatatgtatatgtacattttctttattcagtctaccattgatgggcatttaggttgattctgtgtctttgctattgtggatagtgttgtgatgaacatatacgttgcatgtgtctttatgatataacgatttatatttctttgggtatatacccagtagtgggattgctggatcaaatgagagttctgtttcagctctttgaggaattgccacggtgctttccgcaatgcttgaattaatttatactcccaccaacagtgtatacatgttcctttttctctgcaacctcaccagcatctgttatttttggactttttaataatagccattctaattggtgtgagatggtatctcattatggttttgatttgcatctctctaatgatcagtgatgttgagctttttctcatgattgttggctgtatgtatgtcttcttttgaaaagcatctatttatatcctttgcccactttttaatagagttgttcattttcttcttgtacatttgttgaagttccttatagatgctggctattagacctttgtcagatgcatagcttgcaaaaattttctcctattctgtaggttgcctgtttaatctgttgatagtttattttgctctgcagaagttttttagtttaattagatcccatttgtcaatttttgcttttgttgcaattccttttggcatctttgtcactaactctgctcattcctgcatccagaatggtattgcctaggttgtctggaccagagtttctatagttttggattttactataatggtacctttaatattaatgaaacctataaaccatgaaagttactgtagaaaattgtaacaagaatctatttcaacccttctattgtgcaatatgttatatacacatatcacagctttttacctttagtagtaactaaaatgtgcatgtttattgattctgcatttgccacactatgttccatgaaacactgatattccaaaaatattaataccgtagtagtccccccatccacagtttcactttctgtcgtttcagttatgtgcagtcaagtgccatccaaaaatattaatattgagagaaagttattataaaaataataacttatagtatattgttatcattgttttattttattattgttcttaatctattactgttaataattaagtaaagtttatcataggtgtgtgtgtgtaggaaaaaacagtatgtagagagtttagtacattttcagtttcaggcatccagtatagatcttggaacatatcccgtatagataagaaaggactgctggaaagattcaaatgggatgaataaaaggattctcaggcctctcagttctttcaccatctttcacccaatgatgtccttcatccttcctaagccactggctccaatggtcacaccctagctcctttcattactaataactatcactcctctataactttcatttcagttatcactctcttcagttgtcacttctttctatttaactccctctagtaattgaactgtgataaatctttgatcaccgtggacctccaattctttttgattggctccttacctctttcatttccctccttacctagcttacattatgtaatcaatcgaatactctattaaatatacctttaattttcatgtccttctcgtcatattgtcttttcttgggtgaatagtagccacccagagataacagataaccctgaattaacaagacattcttgaagaagttaacctgcgagaactcgctcgaccagttaccgcactggcacaagggcaggtaaattgcccagtagaatagaatatagccagaaagagatcaaggcatatgtggatgctggacttacggccaaggtggcattgcaaaattgcaatttttttttatcatatattaagttttagggtacatgtgcacattgtgcaggttagttacatatgtatacatgtgccatgctcgtgtgctgcacccactaactcgtcatctagcattaggtatatctcccaatgctatccctcccccctccccccaccccacaacagtccccagagtgtgatgttccccttcctgtgtccatgtgatctcattgttcaattcgcacctatgagtgagaatatgcggtgtttggttttttgattgggtgtcttcaaacagaaacacacataactcaagtttatatatctatctattgatgaaaatgttgtgaccacaggcttgcagcaatctaaacttttatttctcctaggagcagtggttcagtattagctctttcagagtgtgtggcaattttatagaaataactattacaactactgagaattgactatttgatattttgtaaactattgtaaacgttatcttttgaaaattccacttttgtgaaacaaaaaaataaacctttgtcctttaggaaaaaaaaaaaaaagacagataaccctgtgttgacccttgactcctcttttgtccaaattctcaatgtgtatgtaatccatcattaattcctgttaattctaacctctagaatatatcttgaaattatttactttctccatctccactgctaccattctgggagaagccacagttaaccataggtgggccacagtcccatctgattacttagatagcaggccctgcttttaatctttgacctcgtggtaggcagaattttggactcatgactttcacctgcttttgttactcctgtgaataagttaggttatatagcaaaagtgacattgcagatgaccttaaaatagggaggttatcccgcattatttggttgagcccaatataatcacatgagccttaaaagcagagagaagggcaaaagaggaagtcagagagattggaaacatcatttcttcttgtcagattatttcaaagatgtattcgaataatgaataatggccaaattcacaggtacacgtttagcactatttcttcctgaatagagtattccccatcctaatgaccaatttcatattcttctttaaaataatgaaatttatcacctcagccctgttatttctgatatatgtttttaaaaatcaaagaatttttagaagaatcagatatagtgtgaaaatgaaaataaatttttaaacaaaaagcaataacgtatactttcaaataaatttggtctttaaaaccgtccccttggtatgtgtacaattatacagataccgtttgccccaatgttgaagtttatcctagatatgatttaatatatgagcactttagaaaaattaatgccttgcccttgaaatcacaggacttttttttcccccttcttcctttacttccttcattgctgtttaatccagaccatttccttcctctaccatttggctcagtagcctaggttttctggtctccccagagaagactgccgctgtgcagactgagtggcatgtaaagagcagagctactcctactttgggaagtgcaatcgggcagacttgtcccatgaagtgtatgtcaggaaaaagatggcaggtaataagttcttttgcgtgcttttcacaggctgaaggctgataacatggggatagttgagtaccagaaatattagacacaagaaaataaatcactgccaataatagacttgctttctaacaaatcttaggaatttttgatttggggaaatctttttttttttttttttttgagacggagcctcgctctattgctcaggctgggtttcaatggcgcaatctcagctcactgcaacctctgtctcccgggttcaagctattcttctgcctcagcctcctgagtagctgggattacgggtgctcgccaccacgcccagctaatttttgtatttttagtagagacggggtttcaccatgttggtcaggctggtcttgaactcctgacctcgtgatcctcccatctcggcctcccaaagtgctgggattacaggcatgagccaccgcaccagatgatttggggaaatctttaataatatctttcctaggtcgtgactctcttttgctttagaacttacacatcactgatgtaagagttcttttttttgtttgttttaaagaagtggactctcactgtgttgcataggctggtctcaaactcctggcctcaagaaatcctctcaccttggattccagaagtgctgggattattggcgtgagccagtgaacctagccctgaagtcagttctaaatattgtcaaacatagagtattttactatcattgggccctagataatctttatattttgtcatcttgactgctgacataaggtaattgagcatcatatctagaaagttttttttttttttttttttttttttttgagatggagtctcgccctgtcgcccaggttggagtgcagtggctcaatctcggctcactgcaactccgcctcccgggttcatgccattctcctgcctcagcctcccgagtagctgggactgcaggcgcccaccaccacacccggctacttttttgtatttttagtagagatagggtttcaccatgttagccaggatggtctcgatctcctgacctcgtgatccgcccgcctcgggctcccaaagtgctgggattacaggcatgagccaccgcgcccggccatatctacaaggttttaatgtagatatcattcagactaatttctgtaatcttgtcattgttatttcctcaaagtgctgtaccacaaataagaaaataatttgaatgcaattagaaaaaaaaatttacttttatcccaaagcattagtaagacatggttagcaataatgcatatattttaccttacttattaaacttgtcgtgcttctcaacgcatttcttcctgaggttggacatttttataatataatttagcatttttaaacctatgtatattttttctctcaaaaagtcttgtattccacttatattgtttaatgacctgttcagtcagtgtgtgattctcagttgggaactttcaaagtaattgaacataatttttctctaacccaacttttatttctatctgattttatatatgatttccataattatattattgttcaaatagagcaaatcaaaggtccctcctttgtaccattaacatgtatccacttttcaactattttttctctgttaaaacattttaaaaatatagctacatttggaaatgatataaaagtatactttatttaaaatactgtaggaaaatttcaaacattgttgtcttgtgtaaaattgtaactccaggtctgctcagatactacacctttgctttaaaacatgccttttctctgaatgccactgaaattgtgagattaaaacctatacgttcttttttttttctttccaacttttattttagttcagggtgtacatttgcaggtttgttacatgggtaaattgcatgtcccgagggtttggtgtacagattattttgtcacccaagtaataagcatagtttttggatcatttggttgggtatctttttttttaatggaaaccagaatggtatttattattttacatttgggagaggagatatcctaaagggtccagaatacataagtctcttacgtatgatactcctttttttgttactgaggtatacttataagtgcagataagtaatcagaaggttccttggtaagcgctgaattagaacaaaggcagttaggtaatttggagtttaatagcctagagtacctgatagagatgtgctgggggccacaaccctgtatgtaattttaaagtttctaagtagccacattttaaaaagtaaaaacagatgaaattaactttaataatatatttaacccaatatatcaaaatgttattttaacatgtagtcaatatattaaaattattctgtttttcatactaagtattcaaaatctggtgtgtattttacacttttgtacatctcaactcattcatttcctagttccttcagttgcttaagaaaaattactgaatgtttctgtctcaattttcccatttttataatagagataattgcaaggattaaattagataatatatgatacacagttggcacatgatcttatataaagcttagttgctttctaaaaaatatttcaaacagttgaatatgacgtataatggcatcactgtctcaaggcaaagaacattttaaggattaaattatctgtaactcccgaattctcatctcttccccttggacagtgctgggcacacacgtctctctgactccctattcaaattacgtaaaaaaagaagcagaatcaatgttcgttcaccagttgtagcacatgtgtcacactaatgcaagatgttaataacaagggaaacaaggtcatggggaaggaagggcagaaatatgtgaatgctctaatttctgctctatttttctgtaaacctaaagctactataaaaagtaaaaagctatgatttctttcttaaaaaagtcaaacatgtttgctgtcagttcctgatgcatgttagctgtgacagaatacggcagtaaaagtgacagtttcagcattattaaaatcatcaataagaggagcttagttatgggtaaaaaatctaacaatattttctctgtcaatagtcattcattatctacctcttttaaactaatacatggaaaatatatgcacaaaatggttgtttttcctccatggttgttggggtgaatactgggagttattggtagcattctgatggtaatggcagaaatctttcatacattttaaacactattgctggttttgagaatattttcttctcctaatttcaggttgggtgggactatatcagcatacaagatagtaccagatgaaatagaagaaatcaaggtatagtatggcatttttcacctctacaaacatttagcatcttggtgaggggtggggaagagttgctttttctttatgccattgatatttggctatgttagaatattatttaattctcagttatcatagtgaattaaaaatttatatgtatcagataatcaccatcagatttatctgccatttgcaatgaatttctgactacaatattaggagaatcgaaaaggaaccctttcctgtgtagttcattaaaaatctacataagaaaacactgtgtataagcattggtgtgcatagtggattatctttttatcttgttgcaatttcttttccctataagccttcaccacttttaaatatcagtcttttttttaaattattattatactttaagttttagggtacatgtgcacaatgtgcaggttagttacatatgtatacatgtgacatgctggtgcattgcacccactaactcgtcatctagcttaggtatatctcccaatgctatcccgagctggttttttgaaaggatcaacaaaattgatagaccgctagcaagactaataaaaaaaaaaaaagagagaagaatcaaatagacgcaataaaaaatgataaaggggatatcaccaccgatcccgcagaaatacaaactaccatcagagaatactacaaacacctctacgcaaataaactagaaaatctagaagaaatggataaattcctcgacaaatacactctcccaagactaaaccaggaagaagttgaatctctgaatagaccaataacaggagctgaaattctggcaataatcagtagcctaccaaccaaaaagagtccaggaccagatggattcacagctgaattctacctgaggtacaaggaggaactggtaccattccttctgaaactatcccaatcaatagaaagagagggaatcctccctaactcattttatgaggccagcatcatcctgataccaaagccgggcagagacacaaccaaaaaagagaattttagaccaatatccttgatgaacattgatgcaaaaatcctcaataaaatactggcaaaccgaatccagcagcacatcaaaaagcttatccaccacgatcaagtgggcttcatccctgggatgcaaggctggttcaatttacgcaaatcaataaatgtaatccagcatataaacagagccaaagacaaaaaccacatgattatctcaatacatgaagaaaaggcctttgacaaaattcaacaacccttcatgctaaaaactctcaataaattaggtattgatgggacgtatctcaaaataataagagctatctatgacaaaccaacagccaatatcatactgaatggacaaaaactggaagcattccctttgaaaactggcacaagacagggatgccctctctcaccactcctattcaacatagtgttggaagttctggccagggcaatcaggcaggagaaggaaataaagggtattcatttaggaaaagaggaagtcacattgtccctgtttgcagacgacatgattgtatatctagaaaaccccatcgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaggagaataaaatacctaggaatccaacttacaagggacatgaaggacctcttcaaggagaactacaaaccactgctcagtgaaatagtaacagtcttttagtacatatttttctgggttcctttgaaaacacgatatgccaattgcaattaaaaatttacattacagtaatgaaaaattgacttactctttaaaaattagagcattatgacattattctgtctctaacattttactaagtcttatggaatattaattttctaacataatatgttgttctttttcaaaagcaagattgaataattggatattaataatgaagaataaacaatactggttaaattgttaacaatgacatgtaaagatctcaacaaatcactaagcttgatttgattaaacttttcaatatcaagttcactaaattcaaatctttcaataaattcaaattcaattcaaaataattatttaattctatgactcaagactcaaggggcttttttttttttttttttttttttttttgagacagtctcgctctgtcacccaggctgcagtgcagtggcatgatctcagctcactgcagcctccaacctcctgggttcaagtgattttcctgcctcagcctcccgagtagcttggattataggcacatgacaccacacccagctaattttttttttaattttattttagtagagataaattttcttcaagttggccaggctggtcttgaacccctgacctcaggtgatccatctgcctcggcctcccaaagtgctgggattaaggcatgagccactgcgcccagcctcaagggacatttttgaaaagaaaaaaatcttgtaatttgtttgcattatttttaaatcaagtaagcccattgatctattatatgatacactattagcttcagtatgtcaagtgttctaatgtatggtcaacatcagaaattaatgtggtaattctagcttcaaaaaaaatttcaagaaatttattccaactttgtgtgaacttgtaaaatattttagctaggaggaactttaggtctaatccagatctctcatttttcatatgaggaaattgaataaatattttatttgacattcaataatgacttctaaaaatatcatcaaatgttgttaaagggttggaaaagcatgaggatattacttcttgaaatatattttataatgactcaaaaattgaactctagaaactttaagcaattaataaatatatataaataagcaacatttatgtaaagaatattgaattgaaattatgtattataaaggcaccctgtctgataatacaattaaaatgtgtgttaactgatgaagataaaccaagagttttatggaaatacatagaagggacacctggacattggaaaaagtaaatcagcaaagtctttccaagaggtaacccccaggaaattggagttttatacagaagcatagacatgaaataataggataccagattatagggtataaaataaagactggtaagataaagggctggaagcaggcctttatcccatgttaagaagtttggtttttatcctgaaaattatgggattcctttatgtgatttttaaggaagaaagtaacataatcattttgatacttttttaaagccttactgtggtgaatgagaaaagtgatttcagcagagaagaggttctacctagatggaaggagaccaggttgcaggaatgtaggcacaaaatgattagaacctgaactcaagcagtgacaatgaggctagagaagaaaacaagatttgaaaaatattatttcagaaagtaaaatcagcaatacttgataacttattggatgtttaggggaaattggaaagattgactcagatttctggcttgggaaattgagtagatggtgttgctgttaacttaaaaaggatgttttggagacagaatattattaataggaaagaggatgttttggacttactgagtttgaggtccctctcagattaccaaatatccaataagtcattgaataaatcagcctggaactcagaagagagacacaatctagtaattgatattaaggtttgtcctcatacaaaagagttaattgaggccatgctagtcagtgaatggaatctcacggaaaagttatatgaggtattaaaattgggctgaagatgtaaccttaaggaagacttaccctaaaggcagagtattaatatattatttaattagtttaattaatagcaggacttttgcctgtttttaaatagtgatttttttcctaaaggaatcagctttttttttttcattgtgtgtgctttttttattttagagttacaagagttatccctcaggagattccttttaaaaaaagcaggattcatggatgatatgtaacataatttttccgtcgattactggtattatatctaaaataacttgagagtttgaggcctgaggcattaaaaaaatgaggaattcatcttgctttcaaagtactcaaagaaaaactgttctaaaacatttcaccaatatttgatggcacattagcattttcagctgaaatcagttacaatcgtttttgttttagctgaaagaaatgtgaagcatacggatgtaatgttcatttcagttgggtaatatctgagtaatcttaaattgtctaaacagaacaattgagtttgaatttgatatgctacctatagtatataccatgtataaataaatatgcatatgtatttttgttattaaaataatatgactgattaaacataaatcacattttggcagatgtgggaatctttcacagttttctagcaccagaaattatcaagttcataaattttttcaattacacgtatatttattgattgtaataaatcacttcaaaactgaatggattcttagcccttagccacataaagagtgaataaattcctggcccaatcagaagtccctttttcaccctagatgtaaccactattctgacttctttctttttttttttttttgatacggagtctctgtcgcccgggcttgagtgcagtggcacgatctcagcacactgcaacctctacctccccggttcaagcaattctcctgcctcagcttcctgagtagctgggactacaggcatgcgccaccacacccagctaatttttgtatttttagtagagacagggttttgctatgtgggccaggctggtctcgaacctcctgacctgaagtgatccacctgcctcggcctcccaaagtgctgggattacagacgtgagccaccgcgcccagcctactattatgatttttatcattatcaattccttgcttttgttccgttttaccaactatatacacatccctaaacattacaattcatgtttgctctctttgaacttcatatgaattaaatcatattgtatgcagtttttttgtgtcttgcttttttatcaaccgtttttgtaggattcattcatgttattgactgtaactaaggtctttgtttaattgtaaaatacaccactgtaccacagatcactgagacatcctactgttgaatatttagcttgtttccatttgggacgattatgaaaagtgatgctataaacattattataagagcatcctggtactcatgtataagtttctctgaagtgtatactgaagagtggaattcctgggtattaagaaacatgtattttcaactttcctgactgaaatctcacttttctaaagtagttatgccagtttacactaccatcttgaatgcatttattttaaatagatatatttaaatattctttgtctgcaatgtatattactatagattttatttatatgtgaggtgactaaattgatacaatatttttaaaatgtgtctttgtttttccagcccatgggaaaaatcctgagggataattcttaatgaaaaagtccatttttgccccactggtttgaattttgcctcatgtatctcatactaaattttccaatttaggacatatgcatacttaagtctgtcttttcctgaacttctgttccattaatctatttattcttttctcagcactgtatggttttgattatagtgcttttttagcatagtaggaaaggtcctgtgttgtttttcttttttattttattggctcatgtattgattgctccagataacattataatatctctgtcatgtttcaaaagtattcctgctgaggagacttccagccaagatggagtagctttattccttccagatccttcctattactactaaaaatgcctaggcattataaaataaacatagaaagattctgggccaggtgcggtggctcatgcttgtaatcccagcactttgggaggccaaggcgggcggatcacgaggtcaggagattgagaccatcctggctaatacggtggaaccctgtctctactaaaaatacaaaaataataataataattagccatgcatggtggcatgcatctgtagtcccagctacctgagaggctgaggcaagagaagaatcgcttgaacccgggaggtggaggatgcagtgagctgagatggtgccactgcactccaccctggatgacagagcgagactccatctcaaaaacaaacaaacaaacaaaaaaaccaaaagaaagaaagaaagattctgaaagatggaaagaagaaggcagactacctggctacctgggaacctcaggaattgagaaatgacatggcagtgagttacttgggtttccttattatctcctgtatattctggacaggatactgaagaaagccttcaacctggaaccaccaacaggtggcgtaaacaaaaaatacccctacaaaagcctgtttgtctagccaacagacaaggacaagggtcacctaagaggcaagaatggcttttcagcaatatttgccctactacagctaagcaccaatggaaaaactgttcagttcccttatagtttcagttgagtcaagcaggcagctgatattccacatcaccccctgccatcccacagaagtaagtggcatagttctgaatccctcacctggtggtggcagcagggctgagtagggagctattcttccatctttcacctggcagagcagatgtcactctgatttcctggctatgatattaaagttgaaaccaagcagaagttgatctatcaccagcccagtggaaacaagctgtgctccagttttcccagcagggtagtgtcagtggagtccagtgatgagctgagcctccatccccattcagtatcagtgagacttaacaaggcagcacaaagtagagctagttaccactatttcacctttcctttcccacgtaagtgaggcctggcagagaggtgaacctctacccccagctgtatcaacaaggctaagccaggtgaggctattcgtacttctgctcacaatatgagtcaaccatctactctccccaacccttggtattagcatgcgcccctacttggtatcaacagtggagcaaggtaatgtcaactttcaccagaaaggtctcagcagagccaagaagggagctgaacttctaccttacagtcttaaattaagcagtgtgaatcagtgcttcacttttgccagagtggtgtcagtgagaccttgcagaagctgaacatacatgtccataaggcccttgtgttacattgcgacatgggggacatctgctaaaaaagattaaatagtctcaaatataaaataccaaatgtcctaggtgacaataaaaatatcagtcatcataccaagaacaaggaaaatcacagcatgagtgagaaaaaaacagtctacagacaccaacacaaagaagattcaggtgttgaaattatctgacaaagattttaaagcacctattataaaagtgcttcaataagcaactatgaattctctttaaaaatgaaaaaatggaaaatcttgccaaataaaaattataaaaggaaccaaatgaaaattatagaactgagaaataccatcaccaatatagaaaactcacagggggcaacagacggaagtggcacaacatttttcaagtgctggaaaaaagaactgtcaactacaaatgccatattcagtgaagttattcttcaagaatgaataaggacatactcaaacgcgaaaactaaaagaatgtgtcactagaaaaccactctgaaagagtggctaaataaattctttaaagggaaaggaagtaatagaaaaaggcctgaaatttcagaaaggagaaaacagcagaatgggtcaatacaatagattgtattttcttataatttttaaaatcacagttatactgtataatatggtattctatatatgtacatacttaacacaatcatatttaaaatgtggaagggtaaagttgcctaaatggaggtaagatttctgtatttcacttggaatgataaaatgtcaatactggtagagtgtggtaagttatatctgtatattgtaatactgagaacagccactaagaaaagtatacaaagcaatatactcaaaacgctatgaataaaggtagaattctaaaaagtgtttaagtgattcacaataagcaagcatataaaaacaggaaaaagaaacaggacaaaaacagaaaatagataataaaatggcagacttaaggcctatggtcttaatacttaccttaaatataaataatctaaatatgccaattaaaagacagattttgacagaatggatttttaaaaaatgatccaataaatgccattctaaagaaactaatttcaaaaatgatgacataagtaggtagtaagcaataggatacagaaggatggcgaaagatttatgtgtgaacacaaattttaaaaaaaaaagcaggagtgggctgggcacagtggcttacgcctgtaatcccagcctttggggaggtcgaagcgggtggatcacctgaggtcgggagttctagaccagcctggccaacatggtgaaacctgtctctactaaaagtacaggaatatccaggcatggtggcacatgcctgtagtccccacgactcaggaggctgaggcaggagaatctcttgaaccggggaggtggaggttgcagtgagccaagatcacaccactgcactccagcctgggtgacagagtgagactccatttcaaaaataaataaattaataaataaataaaatttaaaaagcattagtggctgtattaatatcagaccaagtagacttcagaacaagaaaaattctggagacagagaggacatcccataatgtgaaaggctcaatccaccaggaaaacagcaatcttaaaagtatgtgtaccaaaaattgaaatatacagaatgctccaccaaaaattaaacaacacacattttttttcaagcacacatgaaacatttaccttggaaaaccatatcctgaatcataaaacaaaccaaaacagtacttaaaaattgaaattatgcatagtatgtcctctgaccataatggaaccaaaccaaaaaaaaaccaaaaaacaaacaaaaaaaaaaaacagaaaaatatcaggaaaagctctaatacatgccagaggaaattaaaagatactctagtaaataatcaaataagatgtctcaaatgaaattttaaaaatttacacaaacgaaaaatgaaaatataacacatcaaaaaatctgtaaagcagtgaaagcagggctgagaggaaaaattatatgcaaagcagacattaagagaagaggaaagttctcaaatcagtaatctaagttttttcctccagaaactagaagaagagcaaaatatattcagagcaatcaaaagaaagaaaacaatgaattaagtattgaaataaataaaattgaaaacaggaaaacaatagtcagtaaaataaaatctgcttctttataaagctcaaagaaattggtaagcctcttgctacattgcaaagataaaggagaaagggcacaatcaccaatgtcatgaataaaacaaggagtattactacagatcttctattctttaaaaggataattaggtaatactattaaaaacttcatactcataaattgtacaatttagtagaaatggaccaattccttgaaaatcacgaacttctaaaactaaccaagatgaaatagacaatctacatggtataaaagccattaagtaacttaaattcataatgaaaaagttcctgaaaaagaaagcctcaggactttctttttggtttcactggagaattctaccaaatatttaaaaaagaattatcatcagttttagtcaatctcctccaaaaaaataaaagatgaggaaatacgtttcatgagtctagtataatgttgataccaaaaacagagaaagacagtgcaaagaaagaaaatggaaaaccagtatctcttacgaactaaaatcctcaataaagtattatcaattacatgcaacaatgtataaaaagaattaagtgccacgacaatttgacatttatttgaaatatacagaaaactacttcagtagtagaaaaacaataaatctaatctaccatgtcaacgagctaaagatgaaaaatcaaatgatcatatcgattgatgcaaaaatagcatctgacaaaattcaaaacccattcataataagaactctcagcaaactaggactagatgggaccttaacttgattaagagcatctagagaaaacctatagctaacagcatacttaatggtgaaagaatgttttccttcaaaaattggaaacaaagcaataatatcttctctgactacttttattcaacatagtactagaaatgctaggtagcacagtaacgcaagaatatgtgctaaaaccacatagattagaaagtaagaaataaaactctccctgtttgcagaccacttgattatctgcataggaaaaaatgactataagaataagtcattttagctgctttgtggcatataagataaacacaaaaagaaaaaaatcaattggatttctatatactataaacaaacatttggaaactgaaatttaaataacaccatttacaattgttcaaaagaaaataaaatatctagatacaaacttaaaagcacacatatgttatctttatgcaaaaactgccaaacaaagaaataaaaggacacttgaataaagacacattctgtgttcaaatattgaaaaattcagcatagtaatgatgtcagttctcccctaattgaaccataaatttaatgctataccctggcaagtgttttgtggctataaaattatataaattcattctaaaattatatggaaaaacacaaaacctagaacagctaagacaatttttaaaaagaacaaagtggaaagaataactctacccaatgaaagtttcattctgtatctacagtattcaagatagtatagtattggcagagaaataaaaacataaatcaatgaaacagaatagagaacctataataggcttatacaaatatattcaattggtttttaataaagatgcaaaagcagttcaatggagaatagacttcaacaaatggtgctggagcaattggaaatcaacaggcaaaaaaaaaaagaatctcagtctatgcctcatgctttattacaaaattatttcaaaatacatagtaggctttaatataaaaagtattatatatatatactgtaaaactgtcagaagaaaaaaaaaagcaaaagtctttacgacctggggctagatgaatgaagaggccttagactcaacacaaaaagcacggttcatacaatgtaaatttcacaaacttgagctcatcaacataaaaaaattttgttctgtgaaagaatgaaaacaaaaactgcaggccgggtgcagtggcacagtcctgtaatcccagcactttggaaggccgaggcaggcggattaccaacctggccaacatggtgaaaccttttctctactaaaaatacaaaaactacccagacatggtggcgggcacctgtaatcccagctactctggaggctgaggcgggagaatcgcttgaacccaggtggcggaagttgcagtgagccaaaatggcaccactgcactccagtctgggcaacagaacgagactccgtctcaaaaaagaggatcaaaacaagacaacagttaatctatgaatgacaaaatattgacaaatcatgtttttaactgtgattgccctaaaacacacaatgacatatgatgattttatgtaatatttataattattaatgataacatactgtaaatcatatcagaattgtaggagtttcccattatttggaacacataccagtaacatatttatacaaatgcagctaaaagaaagctaacatcatttcacatttgacattgcatcctgtatgatttgtataccaaataaacatttcatctttgcattgatgtgctattaatgttaaacccactccttttgtttgtttgtttgtttttgtttatgtttttttgagacggagttttgcccttttgcccaggctggagtgaaatggtacaacgtcagctcactgcaacctccaacccccaggttcaagtgactctcctacctcagcctcccaagtagctggaattacaggcgcccgccaccaggcctggctaattttttgtagttttagtagagatggggtttcaccatgttttagtaaagatggggtttcgccagtaggctgatctcaaactcctgacctcaggtgatccacccacctcagcctcccaaataaacccacttcttaataaaacctatccagttttaatcagtttgaccagaaggtaagatttttctaaacgttgtataaccctttacaatttttgttaaagagcagatcagtgttctgagacaaccctgttgtgcttttattccaatgttcaatttatggaaaaactgaataatacccctttaactatccagtatgttcacacacagaatctcttttacaattaatttttcacaaaccttccacaatttgttcaaaccttcatctttatcctaacttaaaacaatcctttaatatttaatctagccaaataattccacatttccatgccttcttataatcttttaccaaaagcacatcttactttccttacactttgcatgtaaaactgtttcttcagtagtctcaattatgtgttacaatgttaactcagcaatttttatttttaagccatttaattagagctctttcctatgtaaacatcatacacacaacacatacaaatacatacacagacataagatccagtagttaaaaggtttttcacttgccagtttcttaattcaattactggctttagggttgatcccttggaggaacagggccaggaaagcatgcagtttctatggcctaataaccaggctcagctggaaggcaaaaacaggtccccagaattaagggtctcatttttatactgaatcctggatccccaaaagagaaatgctatgtaagaaaacagtgtgatgattttactgtgcatttcattgcaaagcaatctgaagccaatcagcccatccccatgggaatcttctctcttagtgaggggtggggacatcatcataccttccaggtggccaggagcatgcttctgtaatccaaacgtgcagagagctgagtatctttccataactgacattagctatccccaaaagtatatttcctacccagttgttacacaccagagttctctcataatgtgaagtaatttctgatatcccaaaaaataaaaaacataagataacgtaattcaagacaaaacagaaccttagattttgagagggatctgtctactttcaattcctggggtttcatgaggaaaacagaagtttttcccaaaatggggtctgtggtgccttctctgtttttccctaggctgttaaagcttgaatatttacttttaattaagcttttaaccatagcactcttttaaaaaagtttttttaaaaatctcttattacccagctttagtcacgccaaactgccaatatttctggcttttgaactttactaaatgtaacctcccaggggctcagtgaaaggaaagtttaagacagttcatggaggagaggtgaatcaacaaatggcaaaggttacccaaagatcagccaggaagtactcattacctaggctgaaaattgaacctgaatccagggccactattgggaaaagacaaagctttaactgctaagctacagcactgggcaatttctattgcccttcccagaaaaagcctagagcagtaaattttgagtttgaaatggcttttaaatgctcaagataatttttagagctaagtaggacatgaatcccaaaattcctatttcctggaaggtagagaccaagagaaggtactgccacatgattacaaggtcaagctcccaaggacatttttcagcatgtggtctctgggcaagatggttgccctgtgtaacagaaaagataggaaagggaaaggggagaaagagtttgcactgcctgtggcagggcggggagggtcagggaactcaggagctcagggaagccagagaaagtcccacccattgcagtgacactgaatgaaaagttcaggcagccacttgtcagtaatgaagggtttcttttccacaagacccatcagctctgaagtttccccctttggggagaaaaaagctctccatgtcccataattttgtacatgcctaattctgtcaccaacagccatcagcaaagattgcaaggcagattaatccaaagagaatagtaattaaaattctttaatgccaaatacatttttaaccaaatggactttaccaagaggggcctctaaccccctcaatcttaggaagaactctaaccttcctatgttgggccttgaacccaagttcattcaagcatccttgccttttatcaagaggggcttttaacccactctgtcttaagagagactctaactttcccaagttgggactcaaacccaatcccatcctttacctgggtaccccaccacttactgaaagtcggccaatcagtgctgcagtctatttcctttgggttgggggtttcctcagtattgtccctttgggggttatcagggagatgctgcctgaacagggtcctgatccagccccaagagagggttcttgaacctcacagaagaaagaattagagacaaatccataaaaagagagcaagtttattagataaataaataaataaaatggctacccaatgggcagagcagcagcatgagctgctggttggccacttttatggttatttcttgattatatgctaagtaaggggtacattattcatgagttttccaagaaaaggggaggcaattcctggaactgagagttcctcatttttttagaccatatagggtaatttctgacattgccatggcatttgtaaactgtcatggcattggtgggagtgtcttttagcatgctaatgcattacaattagtttataacaagtagtaaagccaactagaggtcactgtcattgccatcttggttttagtggattttggctggcttctttaccacagcctgttttatcagcaaggtcttcatgacctgtatcttgtgctgaccccctagctcatcctgtgagtaagtgtattagtccattctcatgctcctaataaagacataggagagactgggtaatgtgaaaaggaaagaggtttaattgactcacagttccacgtggctggggaggccttacaatcatggcggaaggagaaggaaaagtcacatcttacatggtgacaggcaagagagcttgtgcaggggaactcccatttataaaaccatcatgtctcatgagatttattcactaccatgagaacagtatgggggaaattacccccatgattcaattatctccacctggcgctgcccatgacacatgggaattattataattcaaggtgagatttgagtagggacatagctagactctatcagtaagaatgtcgtaactcctgggaatgcagccctgtacgtctcagccttgttttacctagcccttatttaagatggagtcactcaggttcaaacacctctgacaggaggatcacttgagaccaggagttcaagaccagcctgggcaacaaaatgagaccccatctctacaaaaaataaataaaataatacaaattagctaggcatgttagtgcacaactgtagttctagctactcaagaggctgaggtgggaggatcacttaagcccagaaagcagaaactgcagtgagctgtgatcacaccactgcacagaaaaagaaaaaaaaaaaaactgtcagtcaaccaaggaatactatttttaaaaaatgaagatgaaataaagacatgtccaaataaaaaagtttgttgtcagcagactcaccatgcaaaaaataaaattacagaaaatttttaaaagcagttgaccagagatagtgagtcaaatgcatacacacaaaaacaaggagcactagtaaagtgcaaagaccagctcagtcagggagaccctaacccagtggtgctagaggaattaaagacacacagaaatatagagatgtgaagtgggaaatcaagggtctcacagccttcagagctgagagcctgaacagagatttacctatgtatttattaacagcaagccagtcattagcattgtttctatagatattcgatgaactaaaagtatcccttatgggaaacgaagggatgggccaaaataaaggggtgggtctggctagttatctgcagcaggaacatgcccttaaggcacagatcgctcatgctattgtttgtggtttaagaatgcctttaagcggttttccgccctgggcgggccaggtgttccttgccctcattcccgtaaacccacaaccttccggcgtgggccttacagccatcatgagcatgtcacagtgctgcagagattttgtttatggccagttttggggccagtttatggccagattttggggggcctgttcccaacagtaaagctaattgtacaattatagaagacagtataagtgcatatttcttgtcctttttctcctaattaatttaaaaaacaatacatgtataattggttgaacctacaacatatagacatgtaatatatttgacagggaaagcacaaagaagatgggtggaagcaaagctgaattgcagtaagtacataacaccagatggtatgtcaaatccacaggaacaaaataataaaaccagaaatgggaaataagatggttaatataataagccatataaatatattcttgtcctttcggtttctttaatagacataaattatataaggtaataattatagcaatcttttgttgggttttgagtgtgtgcatatgtctgtatacatatatgtgcatatacatatatatatctgtgtgtgattgtgtatacttatgcataagtatacacatgcatatgtagtatgtgtagtaatggcacaaaaagagagaagagagaatagaactatttaggagtaacatttctatatttcatggaattaagttctgataagatattcatcgtaaaaccctagagcaacgattaagaatatagctccaaaaatatggttaaaaaagggaattaaaatattacactagaaaatattcacttcatgtaaaagaaaacattaaaagggaataaaggaactaataagagacatatagaaaacatagagaaaaatggcaaatgtaaatccagatatatcattaatatcattaaatgtgaatggatttaacaattcaatcataaggcatacattgtcagactgaatgacaagtatttttaaaaacccatctgtgtgctttctgcagtagacatattgtgtattcagagatacatatggattgaaattaaaaggatagaaaaaatatatattatgctgatatagtctggatctgtgtccacacccaactctcatgttcagtgttggaggtggggcctggtgggaggtgactggatcatgagggcagcttctcatgaatggtttagtaccatccccttggtgctgttcttgtgatatttagtgagttcttgagagatctggtcgtctgaaagtgtgtagccccttcccacttgctctctcatgctgctgctctggccatgtaagacgtgtcttctgccataatgtaagtttcctgaggcctccccagatgcccagcagatgccatcatcatgtttcctgtacagcctgcagaactgtgagccagttaaacctgttttctctataaatgacccagtctcaggtatttctttatagcaatatgagaatggacaaatacacatggaaacaacaaaccaaagaaaaataaaatatataattaaaattctttatcagtttgcatacttctataaaaaggtgcttccctttaactattatttagttatgaattgatacagttaatgtagaaaaaacagaagtgcttaatactttttctttgtttgatttgagttcattaacatttctgaaacttcctttatggcccagtagattgtctactttggtaattattaacatttgatcttgaagaggtctataacatttggcaatggttggtttactgttgcatatatgtacattaggacaaatttatttcttgtggttttcagacattttacatttttattaattttatcaatttttcagttagagaggtatacaaaaatatctaaccactttttatgtggatttgtctattttttctttgaattcagttaacttctacttcatgttttttgccaggtacagtagcacatgctataatcccagcttctctggaggctgaggcaggaggatcacttgagccaatagtttgagtccagcctgggcatcatagtgaaacaccctgtctcaaaaaaataaataaataaaataaatagatagacagatagagaggcacactatcttactgggtattgacaatatttttatatctgcatatttgaattgacacttttaacattctgaaatgtttttcatctctaatagcatttcttgccttataagctacttttttggtatgctaatgctacaaccagtctattttgcttggtgctttcatgataatctattttcatcattctcatttcacccttgtcattaaattttaaatgtaaatgactcttgtaaacatttttttacttctttcctgaaacttgttttgcactcactgtatttagacagttttcatttattataattattaataactcaatgtttgttttctatttagcccactggtttcctttttctcttacttccttaccttattttagattaatacagtagcttttattattcagttttcttcttcagttaacttgttatatattcttcgaatgtgttttaggggtttgggtttttttaaggactacccaagggtatatttcaacatccatccattatagtttctactaataataatcacttttaccatttctaatatgaataattgcttttttaattttaatttctaatttttgtgtgtacataataaatgtatatatttatagggcacatgagatgtttgctacacgcatgcaatgcataatagtcacatcatggaaatggggtatcaatcccctcaagcattaatccttgctgttataaacaatccaattatactcttttagttatttttaaatagataattaagttaatttctgtagtcactctgttttgctatcacatactaggacttattcattcattctgttttttgtacctactaaccatccctacctccaccttaccctctccccctctacccttcctagcctctggtaaccatctttttaccctctaactccatgggttcaatcgttttaatttttagatcccactagtaagtgagagcaatgtttttctttctgtgcctcgcttatttcacttaacataatgacatccagttccactgatgttgttgcaaatgactgaatctcattcttttttatggctgaattatactccactgtatataagaaccacattatctattaatctattgatggacacaggttgcttccaaatcttagctattgtgaacacagctgcaacaaacatgggagtgcaaatatctattcaatatattgtttccttttttttttcagtatatacccaccagtatgctaatgctacaactaatgctgcagtaggatttctggaacatatgccagcttaattttttgtttttaaagaaacctccaaactattcttcatagagtttgtaataatttacattcccaccagtagtgtacaagggttcccttttcttcacattctcaccagcatttcttattgcctgtccttttgataaaagccattttacttggggtgagatcatattatagttttgattttcatttctctgatggttaattatgttgagcaccttttcatatgcctatttgccatttatatcaaatattttgcctatttttaaattgaatagatttttttcctgtacagttgttgagctccttatatattctggtcattaatcccttgtccgatgggtagcttgcaaatattttctccattctgtgggttgtctcttcactctattgattgacctttgctgtgcaaaagacatttaatgtgatatactcctatttgtccatttttgctttggttacctatgcttgtggagtgttactcaagaaatctttgcccagatcaatgtcctggagagtttcccctatgttttcttgtagtttcatagtttgaggtcttacatttaattatttaatgcatttttatttgatttttgtatatggtgagacataggtatctagttcctttttttttttttttttttttgcataatggatattcagttttcccagcaccattcattgaagaaagagtttttttccagtgtgtgttcttggcatctttgttgaaaataagttcactgtaggtatgtggatttgtttctgggttctctattctgttccattaacctaggtgtctgtttttatgtcagtatcatgatgtttgggttattatagctttgtaatataatttggagtcaggtaatatgatttcttccagttttgttctttttccttaggatagctgtggctattctgggttttctgtggttccatataaattttaggatagttttttccatttctgtatagagtaacattagtattttgatagggattgtattaaatctgtagattgctttgggtactatgaacattttaacaatagttactcttctaatccatgaacatggaatatgtttatattttttatctctttattttattagtgtatcatagttttcattaatctttcattaagatcttttgctctttggttaaattaattcctaagtatttacttttgtgtgtggctattgtaaatggggttatttttatttatttttcagattgttcactgttggcagataaaaatgctactgatttttgtatgttgattttgtatcctgtaacttcactgaatttatcagttctaatagttttcttgtgtagtctttaggtttttccacatataatgtcatatcatctgcaaacaaggaaaattttacttcttccctttcagtttggattttctttatatatttctcttgtctgactggtctatctagaacagccattactatgttgagtaacactgatgacaatgggcatactggtcttctaccagatcttagaggaagggctttcagtttttccccattcattatgatactagctgtgggtctgtcatgcatggtttttattatgctcagttatattcagtctatcctcagttttttgatggcttttatcacaaagggatgttgaattttatcaaatgctttgttagcatcaattgaaatgatcatatggttttccccatcattctgttgatatgatgtattacattgactgatttgcatatgttgaacaatccttgaatcccaggaataaatcccacttggtcatggtgaatgatctttctgatgtattgctgaattcattttactaatatttcattgaggagttttgcatcaatattcatgagagatattggcctatagttttcttttttatgtgtgtttggtcttagtatcagggtaatattagcctcacacaatgaatttagaagtattccctcgtctatttttcagaatagtgtgaatagaattggtattaattcttcttaaaatgtttggtagaaagcagggaagccatcgggtcttggacttctttactgggagatattttattacagctttgatctcattacttgttattgctctattcaggttttagatttcttcatgtttcaaccatgttaggttatacatatctaggaatttgtccatttctactagattttgcaatttattgggatacagttgctaatagtagccactaatgatcctttgaatttctgcagtatcaattgtaatgtcaccttttttatttttgattgtatttatttggatcttccctctctctttttttctagttaatgtggctaatggtttgtcaatattgtttaatttttcaaaaaaaacttaaatgtttgtttcattgatctttgatttttttttcttcattccaatttgatttctttctcctctgatctttatttcttttctgctactactcttgggtttggtttgcccttgcttgtctagttctttaagatgcattattagattgcttatttgaagtttcctccttttttaatgtaggcccttacagctataaacttccctcttagtactgcttttgctgtatcccataggttttgatatgtattgtttctgttatcatttgtttcaataaatttttcagttttcttcttaatttcttaattgacccagtggtcattcaggagcatattgtttaatttctatatatttgtatagtttccaaaattcctcttgttattgatttctagttttatttcattgtggtcagagaagatgcttgatattattttagtttttaaaaaatgttttaagacatattttgtgacctaacatatggtctattctagagaatgttccatgtgctaaggagaggaatgtgtactctgcagccattgtgtgaaatgatgtgtaaatatctattagatctatttggtctatactgcagaccaaatctgatgtttctttgattttcttcctggaagatctttccaatgcttaaagtaggtgttgaagtctccagctactattgtgttggggcctctctctctttagctgtagtaatatttgcattatttatctgagtgctcaagtactgggggcatacatatttaaaatttttatatcctcttcctgaattgacttgtttatcattatatagtgaccttctttgtctcttctaatagtttggccttgaaatctattttgtctgatataagtgtatcaattcctgctctttttatgtttttattggcatggaatatctttttccattcctttattttcagtctatggtgtctttgtaggtgaagtgttcttctcgtaggcaacagatcaataggtcttgtttttccatccattctgccagtctttgttttttaatggaagcatttagtgtaattacattcagtgttattattgataagtaaggattttctcctgccattttattatttgttctctggttgttttgtggtcttttcatcctgtctttctttagtgaagatgattttctctggtgatatgacttagtttcttgctttttatttttttctctccattgtatgttttttggtttgatattaccatgaagcttgcaaatactatcttataacatattattttaacctgataacaacttaacactttttgcataaacaaacaagcaagcaagccacaaactaataaaagtctacactttaacgttatccctccactgtttaactttttgttttttctatttatatcttaatgtacggactatgtcttcaaaagtttttataattattatttttaattggtttattagtctttctacttaagataagaatagtctgcaaaccccagttacagtgttgtaatattctgtatttttctgtgtacttactattaccagtgagttttgtaccttcaggtgattacttactgctttttttctgatcgaagtacttcgtttagcgtgtcttgtaagacagatctggtgttgataaaaatccctcagcttttgttgggaaagtctttatttcttgttcatgtttgaaaaatattctattctagggtaaaagatttcttctttcagcactataaatatgtcatgcccctctttcttggtctataaggtttccactgaaaaatctgctgccaaaagtattggagctatattgtatgttatttgtagttttttttttatttttctcatgctgcttttaagatcctttctttatccttgaccattgggagtttgaatactaaataccatgaggtattaaataatcttagggttcaatctgcttgatgttctataccactcttctacaatggctattgatatctttctctaggtttgggaagttctctgttattatccttttgaataatctttctacccctatttctttctgtatctcctctttttaggcctgtaactcttggatttgcccttttgagactattctcttgatcgtgtaggcatgtttcttattcttttttcttttgtctcctctgtgtagtttcaaatggcctgtattcaagctcactaattctttcttctgcttaatcagttctgctgttaaaggactttgatgcactctttagtatgccaattatatttttaagctttagaatttcttgttgcttcttttttagttacttaattctctttgttaaatttatctgatagaagtctgaatttcttctctgtcttgtcttgaatttattcttgagtttattcaacacagctattttgtattctttgtctcagtggccacatatctctgtttttccaggtttggaccctggtgccttatttagttcatgtggtgaggtcatgttttcctgggttgtcttgatacttgcagatgttcatctgtgtctgggcattaaagtgttatgtatttcctgtagtctttgcagtctgtgctcatttgtactcatccttcttgggaaggctttccaaatattatgaaaggacctgagtgttataagctttagcgggcatcccaagcccagtaacgctgagattcttgcagacttgtaaaggtaccaccttgataatcttatacaagatcctaaagaattctctggattatcaagcaggctattgttgtcctcccttcctttctcccaaaaaaaatgagtcttctctcattctctctctctctccccgctgcccctctccccactctctctctctctccctctctctctctctcctcccctccccccgctctctcccccctctctctccttgagctacctggagctgatggtggtgtagcacaagcacccttgtggccaccatctctaggactgcactggatcaggcctgaagccagcacaatattgggtcttgctcaagtcctgctgtaaccactttctggctaccatctatgcccgctcccgctcccgctccctctccctctccctctccctccttgagctacctggagctggtggtggtgtagcacaagcacccttgtggccaccatctctaggactgcactggatcaggcctgaaaccagcacaacactgggtcttgctcaagtcctgctagaaccactttctggctaccatctgtgttcactcaaagtcctgcagctctacaatcagcaggttacaaagccaacagggcctattttcttcccgtcagggcagcaagttcccccaggccctaggtgagtccataggtgccatccaggagccagggactgaagtaaagtccttagatgtccacctagtgttctcttgtagtatggctgagcttgccctcaaaccgcatgacatagtcctttgcacttttcccttcacattccaaaagcagaggagcctaaccccatggcaaccaccatctcaggcttatggcgagtactgccattctacctcagatatttccttaaggcccaaaggctcttctatcagtctgtggtgaatgctgcctggtcttgaactcacccttcaggggagtggtataccctctggcccagggcatgtcccagaatgtcatccaagaggcagttcctggaaatcccaagagcctacttgatgctcaaccccctgtggccaagttggtacccgagttgcaagacaaagtccctttcacttttccttctgcttttctcaagcagaaggagttttgccccatagccaccacaggtgggaatgtgcagaatctcacctgatgccagcaagtctcaccatctcacccaagcccttgatacctgggtatcactgctcattattcagtgcccaagggctctttagtttgcagttgatgaatcctgccaggactggatccttccctacaaggctgtgggttcccttctggtccagggtgtatctagaagtgtccaggagctagggcctagaacgaggacctcatgactctgaccagtgccctatcctgctctggctgagctggtatcccagctccaagacaaagtcgtcctcacactttgtctcctctcctcaagtggatggaagtgtctcttttggagccacaagctgtgcatcctggggttaggggaggggtgatgtcagtactcccttagatggtgtctcagtaggtcgcttccctctccacccccagtccactgtcagtggaccctgttcagccctaggactcacctaattattgcagtccttgtggcctcaactgcctttgaagtttatttgctgccccagagcactttagtgccagatggtgaagctttcaggaactcaagttctgattgctaggatcagcagttcccctatggctagggatggtcagctgagttttatccagtttcgctttctgctataacaagggcaacaccgagttcagtgcctcaaaattgcctgctgtccttctccccagggcacagaaatgctgtctgcaccacacctccactgccacgggataggacaggggtcctgttgactattcaaaactttttctatgtcttcaatgcctcttttagcaatatgaagttaaaaccaggtactatgagtgctcacctgagtttgagttttacgaaggtactttttttgtgtagatagttgttaaattggtgtacttgcagggggtggcggaggcaacaattggtggagctttttgttccaccatctcactccacccctctcttcagtaattgcctttttattcgtatctttcttgaatttgaggaaattcttagacattatttttggttattacttcttcctattctatcttctctttctggaatccaattatactatatttttgagtgtgtcccacatgttttgtggctttttatatttttcctctttcttttttcttgttgtttactttctctgcatcagtttgtggaggtttttttattgttgttgatctgtctttgagtttagtattcctatgttttgtagtgtttctcccttttacctgtgtttgcattatttacccctgatgaactttgtaatttcccttctattatgtccattaaacttttttagattccaatgctgtggtgatattctgtaccatttcatccattttgttaattttttttctattttcttgaacatattaatcatagtttacttgaaagttcttggctgtaaactttcaatgcatctcttttgggggttttttttgttctgttttttcctctcaattttgggttctactttctggcaaatcaagtaatttttaataattttatgttatatgtaaaagactcatattggccataggtgacttaatcatagaacattcctccttcttctgtaggcagaaagtgtgagaaatcaattactacaatcccatcaggaattgagctggattacagctgggctacgaacatggtgggttttccattccctcagtcatgaaagacactaggaggtttagctctaatattcataggctgcagcccagctctcttgtctccagcctaaccaatatagcctcaaaaactagcaaatactttgacaggaaataggcattgtactttggtcagacttacttccctagcaagtctttgtttttcaattattatgaacaatgcaaaagatttcattttgcctttcataagctttttgtctagctttgcatgcttctgtataccaccagaatctacaattgctccaaggagaaaaacatccatgagcttgggtttattcaaatttttaagtttaaatgttttaagaggtttctggctaattcttccttagcagaggttgtctgcctagtaaaattaacagtcagcctatgtccaaaatcaacaaatacacacagtgggggtggcttggtaggaaaagctggacattatccgttttactctggaaagtttcctcctctttggaattttatttcacttaatcattattatttctgcaattatctgatatctttaaaagcagcatttttataattatgtgatgttttccacttgttacagtaaaagtattaccctgctgtgacattttgcatcctacccagaaacagaactcctgtattatattttttaactgattattgctaggattaaataaaaaagatacttctgtttaaatctctttgattctggtttgtgtaatgctctgtgtgtcaggcactgttgtaattgctttaaaattactaactcattttaattctctgtattagtctgtttcacgctgctgataaagacatacctcagactgggcaatttacaaaagaaataagtttgttggacttacagttccccatggctggggaggcctcacaatcatggtggacagcaaggaggagcaagtcacatcttacatggatggcggcaggcaaagagggagcttatgcagggaaactcccctttctaaaaccatcagatctcatgagacttactcactattgctagaatagcaagggaaaaacctgcccccatgattcagttacttcccaccaggtccctcccacaacatgggggaattcaagatgaaatttgggtggggatacaatcaaaccatatcatttcacccctggcccctcccaaatctcataccctcacatttcatacccaatcatgccttctcaacagtcccctgaagtcttaacatatttcagcattagctcagaaatccacagtccaaagtctcatccaagacaagtcaagtcccttctgcctatgagcctgtaaaatcagaagcaacttagttacttcctaggtacaatgtgggtacaggtattgggtaaatatacacattccaaatggggaaaattggccaaaagaaagggactacaggctccatgcaagtctgaaatccagcaaggcagtcaaatctttaagctgcagaatgaactcctttgactctatgtctcacaaccaggccacactgatgcaagaggtgggttcccatggtcttgggcagctccactcctgtggctttgcagggtacagcctccctcccagctgctttcacgggctggcattgagtgtctgtggctttttcaggcacacggtaccagatttcattggatctatcattctggggtctggaggatggtggccctcttctcacagctctgctaggcactgccccagtagggaccctgtggaggctccaaccccacatttctcttctgcactgccctagcagaggttctgcatgaggtccccacccctacggcaaacttctgcctgggcatccaggcgttttcatatgtctgaaatctagatggcggttcccaaacctcaattcttgatttctgttcactcgcaagctcaataccacatggaagctgccaaagcttgaggcttgcaccctctgaagccacagcttgagctctacgttgtcccctttcagccactgctggagcggctaagatgcagggcaccaagtccctagactgcacatagcacaaggaccctggtcccggcccataaaaccactttttcctcttagtcctccagacctgtgatgggaggggctgctgcaaaggtctctgacagtccttggagacattttccccattttcttggggattaacattcggctccttgttactcatgcagatttctgcagccagcttgaatttctcctcagaaattcttttctatttcttttctattgcattttcttttctattgcattgtcaggctgcaaattttccaaacttttacactctgcttcccttataaaactgaatgcctttaacagcacccaagtcacccattgaatgctttgttgcttagaaatttcttccaccagctatcctaaatcatctctctcaagttcaaagttattgaactctctagggcagagtcaaaatgctgccagtctctttgcaaaaacataacaagagtcacctttgctccagttcccaagaagttcctcatctccatctgagactgcctcatcctggactttattgtccatattgctatcagcattttgggcaaagccattccacaagtctttaggaagttccaaactttcccacatttttctgtcttctttttagccctccaaattgttccaacccctacctgttacccagttccaaagttcctttcacatttttgggtatctacagcagtgccccactctactggtaccaatttactgaattagtctgttttcacactattgataaagacatacccgagactcggcaatttacaaaaacattaaaaaaagagagacgtttattggacttacagtttcacatggctgggaggcctcacaatcatggtggaaggcaaggaagagcaagtcacatcttacgtagatggcagcaggcaaagagagagtttgtgcagggaagattccctttttacatcagatctcgtgagacttattcactatcacaagaacagcacaggaaaatcctgcccccatgattcaattacctcccaccaggtccctcccacaacatgggggaattcaagatgagatttgggtggggacacagccaaaccatatcatcctcataacaaacatatgcagtaggtataattattgtctctatttcataagtgagaaaaatgagacacagttaaatgacttgctaaaggtcacacagcaagcagttgtatagcagattcaaacctacagtctgggttcttctataatagtgagagttaatagtagaataaatacaaagcatcattcagtagatcattctgcgtgaatgctataaactcactaagaatcatttacatcaatatgtgttactttccagtactccttttctcttaataagaatgttgtttctgaacttcccagttactataccttcccttctcccaaaggtaatcactatcctgatttctagcaaatgaattatctttacttcttttgagctttatatcaacagaagcattttggtgtcttatgttttattaaatatacaagaattgagttatccattcttttgtggaaggacatttcagttgttttcagtttcagggtattatcaataatcgtgcaatgagtagtcttgtacatgtcttttagtgcacatatgtatgcattcttagatttccacctaatggacaggatagacatgacttagaactaccaagttgtggagtatgcaagtgaattctgcatgctagaatctgcctttctcaaatagatgtaccaatttatattctcttcaacattttatgagaactctattttgcttcacattcttactgacagtattgtcaatctttttccattttagtcattttggaatgtaaatagtgacagcaaaatatgtttttaagttttttcattgattacaggtgttattaaacatcttttcatgtctttattagccattgggatctcttcttttgtgaagtgcctgtttaagtcttttctactttttaagaattagattacttgtctttttcttatttattggtaggtatttcttataaattttagatatgaatcctttgatacatgtatcatccatttattctcctcctcggttgtttgccttcttactctcttaaaagtatctttgctgaacagaaattcctaattttaatgtattggcttgtcaatctttcagttatagtaaatatttgttaagtgaatgatcttgaaggagttcagtgtcagctacaagagataatcattgtaaaacataaattctgtatcaaatttatgtataaaatattttagaccaggcgcggtggctcacgcctgtaatcccaacactttgggaggccgaggcgaggattacgaggtcaggagttttagaccagcctgaccaacatggtgaaaccccatctctaataaaaatacaaaaattagccgtgcgtggtggcctgtgcctgtaattgcagcttctcaggaggctgaggcaggaaaattgcttgaaactgggaggcagaggttgcagtgagccaagatcgcaccactgcactccagtctgggcaacatagtgagacttcatctcaaaaaatatgtatatattttagatatgtataaaatattttggaacacagaggaaacagtgaccaattccaaccagagtgtcaaggaattcttcatggagaacatgatgggaaggacttctaaagcaaaagaaatatgaacaaatgtactaaatgtaaataagcattgtggttttcagaagttcaagtgtggctaaagtcaagggattattaattctatttgcaggaaataagaaggtaagttaggttggagtcacattttaaaggagctgtatgttttggtcgggggcatagtttctaaagattttgaagcaaaggaaagacattttcagatttgtttcaggggatatactgttcttatcaaaatggattgataagagacagagacagaccacttagtgtgctttatagcaatctaggtgaatgatgataaaaataaggcttatgcctgtggcaacaggaatggaaagtactgggggtatatcacagtggttaataaaacaggctctgctccttaataggattgtgaccttatgtgtatcttaaccattcagagttttcctaaataataataataataataataaaacctactattgtcattacgaatattaaatgtttgtaaagtacttagcaaagtacttacatagtaaaggaaaactgtgtgatatgattcaaatagacttcagaaacaagaaatacaaaaaagattaattcagggttttcacttagacagcttcttaagagtcccagtccctgagttaaggaattcaaaagaagcagcatattttgggggaataacgactattaggagtctctatggcatacaagtaacaccatacaactggaaatctatttgctcctccaattaaatagtgtagtccttatttcttatttgttcagtgttaatgattttcatcccttttgttttctcttctggtactattcacttaactgagagtatgctttactgtgttattctcagaataagagcatcccagaggattcgtggaagaaatgcaacactttcgagtataaactatcaaatagccaggttttctctctactgtatttgatcacctagtcccttattttttttaaagcagaacttagtattaccattgtataatgtggagtaggtaattttcctctcaaatcagaacattctgatctggtaaagctaagagttcttggctctctttgaaaagatagattaaatctacctgtctttttgctattttttgctgcctatagatcagtgttatattgttcctcttactaattattatataatatatttacacagaagtcttggctaaagttccatcaaattattatacttctttaaccttactaaaatgaatttcctccactattctttacatataaatacatgtaatttatatagacatatgaagtctatagtaacacctatagtaccagtatttctttactactggaaaactaaatcatagtgactattattaaaaattacttgaaaaccagacctctgtattctccatagggctaaatattagtaaactaaataataaaactgtttccagattttttttgttaaagatttttaaagtattaatagaatttaattaattacataatatatattatccatgtctaattatttgtctagctatattcatcatggaaaaaaatgttcaaaggaaaattgacattatgtgtgaaactttgtcaaaaatatgtcattgatgtttgagacaaggtaataaaactatcacagaaattcttctttttcttactaatatataatattaatatgaagatgtattctcacatcaaattttggtatatacagaagtcagtagtaatatgatttggccgagtacctttgctttcataatagttttataatctttgtgtgtgtgtatgtgtacatacaaagaggcacttaattttttagttcttgttatgtacccaaatttatatcagatgctttctgttctcatttcctttcattcttctaatggtggtccatgtttcaataacttgcctatgagcacaaagctagtaagtagactaaaactggaatgggtacccaagtctgtcttactcccaaacctattccttttctgttacctctgcttctacttccctgccttacagtcagaaaatttataaaggtaaacagtttgtcaatgtgaaaaactaaaagtagtttttaaagtatgcagaatattgtgcagacttaaaatcattatagtgaactacatttattaatacagattgattatttatgacatattgtcaaattgaaaatgcaaattaaaacatccatgtgtggaaacaataaaccctggggatttcagaagcagggaggagcagagtagggacaaggattgaaaaactacctgttgggtactatgttcattacttgggcaatgagatcattagaagcccaaacctcagcatcatgcaatatacccatgtaacaaacctgaacgtgcactcctgaatctaaaaataaaacgtaaaaaaagaaaggatttgtcattcttgaaaggacagaaaaaaattcatgtgtgtgtatttttttatgtatgaaaatatttatggaagtatggtcaacaaaggtttaaaattggttgtctaataaaatgtttgtgatttttaaatttccttatacttttttgttgattgaattatttttggtctttttagtaagcatgtattttaagaatcataaaaatcacttaagactactcttacattcagcaaaaaaaaaaaaaagaaacaaaatataagaacaggttaaaatatagaaaatgtatttttcaccaactgtcatttctagaacctagtttacaattgtataacagatgatacatttaattaaatctcttacatatagtcatccattttttgcatattgcatattctagagcagtgagtaaaatggcttgaatgccaaactcatggatttggtactacattttattgacaaataaaataataggtgtttaagctactttgagaataagcttcattccagtataattgaatagctcctatcagagctcctatctgtatcacaagtaactattataaactctaaaccaaacaaagaaacaataactatctgaaagcactggagagtgctctataaagtagacagattctaccatttggaagaaggcactggttgattatcccattcttaaaacttttagcctgagagtaggccccaatctggcctaactggcagctaaaacctgctggcttcttggctacaagaatggtttgggaaaactatagctacattaaagtaaaaagggaaatcctagaaaggagagagccaaagaggggagcctgaaattctataaataaactccctgtatttctggctgacctctgagccatgaatgagctgggtagactacaaacagcacaactagggctaaagggattgaactgaaatttgaattgccatcctctgcatagcagagtttgcagttaggtctgccgaagtcactgcttactaaaatttaaaaaaatcaatattataacaaaatccagtgtctattcaacatatcactcagtgtccagcatatagtctgaaattatttcacaaagaaacaagtgaacatgacccattcttgcgagaaaagataatcaattgagactaaccccaagatgacccacctattgtaattaacagacaaaaattctaaagcagcttctataatcataatcaagcagtaaaggaacatatgcttgtaatgagtgaagagataggaaatcttagcagaaaaaaatagaaactattgaaccaaatagaaatttaagaagtgaaaaagaaagtagctgaaaagtgttttcagggtatcttctttaaatttaagaccccacctgagccagtgaaatcatttagtaaatatatagcatcattaaataaaactactaatccagctctataaagcaggttgaattggctttcaaaccaacaaaatttattcctacttatttgtgtttgggaagtttttacattgtttgctgttggaacatattaatgtatccatgcatgttgaaattatatgtagaatgaaaggaaaattagaaatattcaagattttactctggaaaattatctttgactacaagagagaaactgcactgaagataattattttagcttagcattttttatgggttatacagtatcaatttaatagtagatagcagaatagctagtttaagagttctataaactaccctcactgacagtctgattcctttatataattttttttactgaagtcaaagttataatattagggaaaagtaccatttctaatcaaatatttataccacgtttaattttttgtgtatgttttgctaatagtgcctactataaactcaaattaataacttttataattattttatagttgaattcaaacaaatgacaacaaaaacactaaaagaatggtttgcaggggcaagggcaagatggccaactagacacagacaagtggaacagctcccatggaagtactgagacaacaggcatgcttttaacagatctttacagggaaggcatcaagagtggaccaggagaagacatagaagctgggctaaaggaagagaaagctgggaacgctgcatggacttttgtgcaccaggactcatttttgaaccacaacagctccaggagcatgggtgagttgaactggcaaggagcaacccgctctcaccatgggcctctggaaccccagcaggaggggacccctcaaccaccacagacacgtgaggtggcagggagagttacttagggaagtcttaagggcagcaagccagctgatgtggagcccagagggtttggtgcagaagtaactgtagtggagcatggccagggacagccatccccctagacttcacttgctcccataagagactttagtcctaggagaactgttggacctgatctgtccagggaagtcttgcgcaacagacagggctggtctgacctgagccctccttggtctgctggcctgtcctggggccctagcctggtcatgcctgctggcagggcagtcttgaggtccctgggtacccacgccgtagcttcaacactgatggaccatgcctgaccagtagagagtttcgatgaggcatccctatggccacgcaccagcctgcacgctccctccccagcctgtgcagctttcctagacccatggcactccccacatcactttgctgatgcatgtctacacaggtggcttttgctttacttgcccagccagcacacaggaacgcagtctgccctcctcccttgctgaccaccattgcagacacccttggtaagcacagagctggcaagtctcactcctgccagcaccccacccttgcactaacattgcacagagaacagcagatcatcccacaccctgaacaatcactcttatttgaggggcacagagaaggcacccagatctatgatggtcagcaccctgcccccaagccaacaccacctccagtgcaacagcacagtctctagcaagggccccccatcccccaccagctgtgttgcctccaccactatggtgaacacctgcagggaggcaggcacccctgcatctgttagcactcttctgcagatgctgcacctcagaaccccagcacaatggactgaacctcaaagaggtcaaactggggcccaatgcaagtcccccagagttagagcacacagtccaggagttgggagctgagcattggcctcctaaaatgttccaaaaacaagattggattcttccagtcagctgaatgcatcttataccataatcaaaccctcaaggttatcaaataggataaaagaaaaaaaatccaaaggtcagcaacctcaaagattgaagatagataagcccacaaagatgagaaagaatcagtgcaagaatgctgaaaactcaaaaagctagagtaccttctttcttccagatgaccacaccatctctccagcaagggtccagaacatggctcagatggctgaaatgacagaaatagaattcagaatatgggtagaaatgaagatcattgagctacaggagtatgttgaaactcagtgcaaagaaagtaaaaatcatgataaaacatggcaggagttgacagacaaaatagccagtactgaaaagaacataaccaacatgatagagctgaaaaacacactgcaggaagttcataatgcaatcacaattattaatagcagaatagaacaagctgaggaaagaatctcagagcttaaaggctggctttctgaaataagacaggcagacaagaatagaaagggaaaaaaagtatggaagggaatgaacaaaacttccaagaaatatgggattatgtaaagagattgaatctgcgactgattggtgtctctgaaagagatggggataatggaaccaacttggaaaacatgtttcaggtatcatccatgagaacttccccaacctagctagagaggccaacattcaaattcaggaaatgcagagaactctaataagatacttcacatgaagatcatccccaaaacgtaatcatcagattctcccaagtaaaaatgaaagaaaacatgttaaaggcagctagagtgaaaggtcaggtcacctacaaagggaagcccatccaactaacagcagacatctcagttgaaaccctacaagctagaaaggactggggcccaatattcagtattcttaaaaagaattccaatccagaatttcatatccatccaaactaaacttcataagcaaaggagaaacaagatccttttcagacgagcaaatgctaaggaaatttattactaccagacctaccttacaagagctcctgaaggaagcactaagtgtggaaaggaaagaccattaccagccactacaaaaacacattgaagtccacagatcagtgacactagaaagcaaccacatatgtctgcaaagtaaccagctaacatcatgatgacaggatcaaatccacacatatcaatactaaccttaaatgtaaatgggctaaatgccccaattaaaaacacagagtggcaagctggataaagaaccgagacccattgatatgctgtcttcaagagacccatctcacatatacaatggcatacactggttcaaaaaaaagggatggaaacaaatctaccaagcaaatggaaaacagaaaatgccaagggttgcagttctactttccgacaaaacagactttaaaccaacaaaggttaaaaaagaaaaagaggggcattaggtaatggtaaaaggttcaaatcaacaagaagatctaaatatcctaaatatatatgcaccaacacaggagcacccacactcataaagtaggttcttagggaccttcaaagacacttagactcccacacaataatagtggtagtctttaacaccccactgacaatattagatcactgagaaagaaaattaacaaatattcaggtcctgaactcagccctgagtcaaatggacctgatagatatctacagaactctccacgtaaaaacaacagaatttacattcttcttattgtcacatggcatatatcctaaaattgatcacatcatcagaagtaaaacgctcttgaggaaatacaaaagaactgaaatcataacaaacaatctctaggaccacagtgcaatcaaattagaaattaagactgagaaatttactcacaactctacaattacatggaaactgaataacctgctcctgaatgactgtttggtaaataatgaaattaaggcaaaaatcaataagttctttgaaactaatgtggacaaagatacaacataccagaatctctgggacacagataaggcagtgttaagaaggaaatttatagcactaaatgccatcaaaaaagttagaaagatctccagttaacagtctaacatcacaactaaaaagaactagagaaccaagagcaaacaaatcccaaagctagtggaagacaagtaataaccaaaatcaaagctgaactcaaagagattgagacagaaaaaatgtcttttgtaatggatgagtataaggctccagatagatacagagaatgatgacttatgtaaacttactctctcttagctctattactgtccctgtttttctgtttgatgagttgtttactctttggcaataattttgctaaaaatttctgtaatcatgttttttattgttaaataatgtaaatgtaaagaaaacattatatatttataaatacatgtagtatttccgaaagttttcttaaaaagggtatacgatctctaataacaccataatatactgatctattatgttaatatactgatctattattaatttgttcatatctctgatgtctgtaacatcaagcacatttgtcatggtttttaaaataatatatatgtgtgtttgtgtatgtgtatacatatatatatgacacatgctgggcatagtcattgcacatactaggtatttgcatgtttcttaaactgaaaattaacttatataatcatattcttaagactttgtgccaatttatttaaatataatacatcaagcttacctttagaactattttgaagctttttataaaagataaacttatcactaatgaaatataaattggaaatagtcagaaaaagaagaggatgccaaaatgttaactgtgaaactagttgtttttgtattgtattgttacattaaaaaccaccacaaaatgtggtggctttaacacatatagtgatttgttatttttcacaagtctgggctttctgagtgggaatattttctcatgtcattatttcagccacatgagtctaaggtcactcatgtagctgaaataatgtcacctcagttgggtctggagaatctaagcctcactcagatgtgtaggaccttggtgctggatattccactagacctttctctccaaatggtcacccatcattcccttgtctagcccagccttcctgacatggtagtagaagtttaccaaagagtgaagacagaagaatggaaaccttttgaaacctaggcttcagaacagccataccatgacttattgccccattccattgatcaaatcaagtcagaaatccagcccagttgcaagggttgtagaaatagaccccacctcctgacaggaggatttacaatgactgtatgaccatatttaatttaccacagtagtatatgtgtaattattaagtataaaatttatttctaaacttactgaccatgagtactaagtatcagaatgaagaatgaataaatgtttataatccctcttttttttaactttaaattgaagtttaggggtacatgtgtagaatgtgtaggttttttacataggtaaacatatgtcatgagggttggttgtacagattatttcatcaccaggtattaagcctagtacccattagttatatttcctgcttctctccctcctctcaccctccacccttcaacatgccccactgtgtgttgttcccccatgtgttctcatcatttagcttccacttcttagtcacaacaagtggtatttggctttctgttcctgcattagtttgctgaggataatgggatccagctccatccgtgtccctgcaaagaacatgatctcattgttttttgtggctgcatagtattgcatggagcataggtaccacattttctttattcagtctgtcattgatgggcatttgggttgttcccatgtctttgctattgtgaatagtgctacaatgaacatacatgtgcatgtgtctttataatataatgatttataatcaattgggtatatactcagtaatgggatttctgggtcgaatggtatttctgtctgtaggtctttgaggaatcgcgacactgtcttccacaatggttgaactaatttaccctcccaccaacagtgtaaaagtgtccctttttctccacaaccttgccagtatctgttattatttgactttttagtaatattctgacttgcatgagatgatatctcgttgttttgatttgcattttgctaatcagtgatgttgagcttttgttcatatgcttataggacacatgtatgtcttcttctgagaagtgtctgttcatgtcctttccccactttttaatgggttttttccctgtaaatttatttaagttccttgcaaatgctggatattagacctttgtcagatgcatagtttgcaaaagaattgtctcccattctgtaggttgtctgtttacttttttgatagtttctgttgctataaagaagctctttagtttaattaaatcccagttgtcaatttttgcttttgttgcaattgcttttagtttctttgtcatgaattctttgcccatgcctatgtcctaaatggtattgcctaggttgtcttccagggtgtttatagttttgggttttatatttaagtctttaatccatctttagttaatttttgtatatggtgtaaggaaggggtccagtttcaattttctgcatatggctagccagttctcccagcaccttttattgaataggttgttgcttgtttttgtcatgtttttcaaagatcagagagttgtaagtgtgtggtcttatttctgggttctctgttctgtccccattgcttgtttttgtcagctttgtcaaagatcagacagttgtaggtgtgcggtcttattttagggttctctattctgttccattggtccatgtgtctttttgtgccaatatcatgctgttttggttactgtagccctatagtatagtttgaagtcaggtagtgggatgcctccagctttgtttttttgtttttgttttttgcttttgtttttgtttttttgcttaggaccacgttggctattgaaatccctttatttttttaatgatacatacaaattacaaagaattcaaacaaggcaaaaatgtaaaaaggcagtaaaaaaataaaatgtacttcaaagctaactacccaagagtaataaatatttaacattgtttataaaacattccaacatctttcactgcttattatgtagctagaagaatgtatggatgtttaaatgagtgaaagacatagctatttaaacaattaggataattttctgaagctaatatatagtagcatttatttacacttaagcagaagaaaagggaactgagtaaaagagcctattgactttgaaataactgttttttattagaagagatattatatgctgaaatccctctaaattttaaaaaataggaaagtcattaataggttacagtcatatgttaactatatgttaaaccttagacaggattggttgaatccttgctatgaaagataaggatatttgcactattacatttcttcccacctaccctctccttaccttccaatttctgtttattatatgattttcagaaaaaaactgataaaacaatatccagtcctcaaactagtgcttatttcaaacttgttgcagagatgtaggaagaaaaacaaaaagtcagcccagactgtatcagatctggaacttgcacagaaaaaaaataggggaagcaagaaaccagagacaacatatagtctttgttggaatactctgctcttctgaaattttattaatgtccagtgctagaatctttcttcctagataagggtttagctcatcattatgtgaggactgtcatcaagtttaagattagttttccatttcagtgtgccttcgtttctagaatcttcatcttgaatgccatgagccctccattgcatgtttcttatagaagctgcttacaataagaaaaagatatggagtctcttttagtttgcatctctgtagatttagaggtattcatgagaatttttaagattttgagaattcaccattatgacctctttggagtccagagtagcattaggagcctcaaaatggagaactgtgtgtctcaaagatcttttgtttctgtccttaaccatccagcttttgagacttacgaagctatgttgtttgcttatttggttgttgcttgtggaggtttttcctctagtttttactcttttatgttgattttatgacatattaggagggggatttttgtgatacacctttattctactaaagatgaatggaatggaatactagaaatgcaaggcaataattttttaaagaaatatcctccacataaggaaaagttaatcactaaaataaacaatgtcctcagcctcacttttgcaacagatgcagagggacttttcataagttgctttcatgaaaaaatcttcaatgacctcttatttggtagaggcagctgaatattaaagttttgtcagaataaagtggatctaacaggtgcagaaacaaatatggcaagataaattgctttctaactaagctaagataaattactaagttaaataagataaatttaataagttggtacagtaaatagctaagataaactgctttttaaacatgatagaataaaaagactcagtatctaatgtggcacatagttcagtttaatatgtatacatatatcaccttgaggtatctttcttaaaatgcagcttctgattcagtagatcttggatggaacttcaaattgtgtatttctaattccgtgacaccactggtgccagttctcagatcatacttttagtaacaagattctagacaactatagactaagagctcctctacttgactgaatccttgagaccagagatactgccttatttatctttgcattgctgttctctaaggaagtacctgaataaaagtttgccctgaaatattttcttgttaaatgaattaatgaatcagatgcatgacaactaggggcctggagaactggtattctatactggtgggtgaggaagaattcttttgttttgaaaaccaagtgactgaatgataggatttctattttgtcttaaaatctaaaagccttactaaaatttttgctcacatgaagtctgccatatatcacattagctactttggccaacaaaatattacctcccaaatgcttgaatagattcttaattgctctcaagataacaaatgttattcaagtgaaagaaatctatatattaagtgttaccagttatccatcctggaaatagaaaaactttagtaatattactgtaataaaactgatttttgtttgtttgtttgttcgagacggagtcttgctctgttactcaggctagagtgcagtggcacattctcggctcactgcaacctctgcctccctggttcaaatgattctcctgcctcagcctcccgagtagctgggattagaggcacccaccaccgtgcccggccaatttttgtatttttagtagagacggcgtttcaccatcttggcctgggtggcctcgatctcctgacctcatgatccacccacctcggcctcccaaagtgctgggattacaggcgtgagccactgcgtccagccaactgattttaaactgtatgaaatctttttgggcctacccaactatctgtgaaatttacccttgagtaattgaacagatcgtctccttagactagtagttttcagttgctggctacattttagaattacctgggaagcttttaaaaatcccagtcagtgcccaggctataccaaagaggtgagacccaagtattttttaaagctccgcagataattccattgtgcacccaaggatgagaaccattacttgactattagctctttgaaatctgagtcagtgttcctcttatttttaacttttaacacttaatacatggtaggtacttcataaatgtttacttagtcaacagatgaattatgttataaggaagtattatctgaggcaaaacaggagcattcttcagtataaagggaccatttttactatgtttattagcatcttaaaatttgaaaagtttgaataccctcttaatgttaatactgaaagttggtatttgatatagataaacattttggtgttgagatattttgttgatgcaacttggatttcatatcactttttatcaagatttgatataaatggattgtgatcagaggtgagaaaactgtggcacaggcatttcactaccgtaatggaagtacttaaaggaatgttacaaagagatctaaggtgttctaggatacatcagtcggaaaacaaagatggttaatctacacattgctgagttgtggtatcaaccgtggttttgttttttgtttattgttttcttgagacagagtctcattctgtcacccaggctggagtgcagtggcgcgatctcagctcactgcaacctctgcctcccaggttcaagtgattctcttgcctcaatctcctgagtagctgggactacaagcgcgctccaccatgcttggccaatttttgtacttttagtagagatggagttttgccatgttggccaggctgttctcaagctcctgaccttacgtgatccacccgcctcggcctcccaaagtgctgggattacaagcatgagccactcacccagctggtttttttatataccagaaagaatagagagctatttataagagtgagtatttaagcttttctgctttttaaaatgaagcacagacaattgaagttttaacttcggtttatgaaaccactttataagcacctgtattataataatcattgatttttgaggggctttcctcagaacaaaattataactatatctgggatcaaagttctttagatgggctctcagttatctacaatttatgtttttaaaaatagtttgttgccattaattaatcattgcacagaaaagttcccttcatttggagctctgagctctgcatttctgtgataccagaataaaacacaaactgaaaaaaaagggaaaaaatcattttttaggtcttggatttattctaaataatcatcctacattttgtgtcactgatgaatttgagaattgtggggaccgtattgtacatctcggtatcagcctgctatttgtatttcacaacagttatcggcaattaaatgatgaaattctatttttaaattttgactctgaattataaaaacgtaatgaaacaatgtaataccaatgcaagtatatgattataatttaatgagcacttaattgccctttttagcaaatagctaaaatgtagaatgggttgatagaattagcaagaataagaaaagtcagcagatggagatcctagtttcactttgttataaactaggtgtgtaattttgtaaattatttaagcacattgtacttcagttgtctctttagaaaataaagaggcaaatctgctaaagacccttctagctccaaaattttatgacatgtaattctaatctctataactgtcatagtagtgcattttgaatggctgaaaagaacttcagataagccattaattataaactctttatttacggttttcttatgttttatttactttcaagaatttgatacttgcatcctcattttctataattaataaaataagtactcaaaatttcagtgccttttgatcaagagtgaaactgttccatgaattgtgcttagaaattttcttactgactgttgaaaagaatctgtgtttcctcgttgaatacaaagtgtcctaggactgggatgttttgagcaagcaggcaaatttttctgcacatgactatactattgttttctttcaggaaaccctgatagattggtgtgatgaaaaggaacttaatttgatattaacaactggaggaacaggatttgcaccacgagatgtcactccagaggtgagatagtacatgccttttcatattcaaggattaaactaatcatggtttttttaatcctttttactatatttatattatttttataactttgctaggcataacaaatgacttgtagttctaataatgtgaaaattttgctgtggatgaattgtgaaaaatgtttcctgactttttttctttgggcttaaactagaagtgatagaatatgaggaagattaaactggtccagaggtaatctgtcattttcttgatgtcagcctaatttcaggcacatttccaaaggaagtgatagcagaattctgatggttagcatggcatctggtctgatgtgctttgtcaatacaattcttttcttgaggtacccttttcatttgtctaaaattacagtaagatgactgcaatagaatatactgattttacagtacttttgttgaaaagggatatattttccacaattctaaatgtgaacagcatttaaatgcagaatttaatgagcccaaaagtagaattaatatctaggcttaagaccacaggaagcatcttcaactattttatatataggaagaaaaattagggaaagaatgaagaataagcactattaactaatatggggggggatgtattttttctttaaggaagccataaaccacagatgtcacctcagagctatacataaaattacatcaccacttgtgacattgtttcctttacctacccaaccccccaaaagtgtttcttggatcagtttcaacttaatatttactatgtctttctatttcaaatcagtacactattgtatctactaccttattaacattccacaaggtacttttgctctgcatctattaaataattactggccttcttataatagtacaatggttttcaaacgttagcctgcatcagaatcaatcagaggacttattaaaacacaaattgcttgaccccccacccctagagtttctgatttagtaaagctgcaatgggtcttgagaatctgtatttctaacaaggccccaggtgatgcagatgttgtcgttgttgttggaccatagaccatattttcactatatgaaaatgcaattttaagaattattttttttctattcctctatataaaaaccgtggtacataaacttttgatattattataattagggttttaaataaaatagttttggcttttaaagcaatcaaaatcgagtcgtattgagaggttaacttcaactgcataaagtcatccttacacaatttatttagcttctggcttctatagttagtggttctttggcaaagttttacatttcttttatgctatgactgactgaaaaagtacaattgggaaggaagccatctcctgcagaggtgtgcttgtgttttgtttctttgtaagaacattgactacttatgttaagatatggatttttggagtttgggtgctgtcttaagtgttttagtaaatcactttgcgtttatgtatgcctattttttgtgtgatggtttgatattttcatattttttcataacagaaaaatagaaaaaatttcaccagaaaattaattcataaccaaataacagtattatttttaattccttggataattgatcgtggggaaataatttacatcacaaaatgttttgtatcctactgggctttcagttaatacaaaatgctaggctgaaaattcaaacctttgaattctggctctgctacttatcaacaaggtgaccatagacggagtgcttttactcacacttctgatgctaaatgtgggtttttttactcgaaccagccagttcttcaactctccagatatcaaatgtccttctttttatttcaattaaattctgacactacctaccaggaattagtactagactctgcagatttaagggctgtgtccacaagattgccttcacgtcacatgccagtggcaagtaccagatccccaggctagtcaaaattctgtcctacttgactacaaagtcagttggttcccaaaccgcgtcccccaccccactctgcattttcagattcactaatttgctagaataggtccaaaacctcctggaaacactttacttatgcttaccagtttactataaaggatacaatttaggaatagccaaatgcaggagatgcacagggcaaggtataggggcaaggaggttccatcccctctcagtatttagcgcccctccggcaccttgatgtgttcatcactctggaagctctctgaatcccattgttccaagatattttatggagctcagtctccaacctcacccctcagtgagtggaactgaaaattccaatgctcataataacttagtctttccaatgaccagaccagccccatcctgaggctatctaggcacccaccctaagtcgtctcattagcataaactcaggtgtgatctgaagaggtttgggcctggcatggtggctcacacctgtaatcccagcactttgagaggcccaggcgggtggatcagttgaggcaaggagttcaagacaagcctggccaacaaagtgagaccatgtctttactaaaaatacaaagaattagctgggcatggtggcacacgcctgtaatcccagctacttgggtagctgaggcatgagaatcacttgaacctgagagtagaggtttcggcgagcagagatcacaacattgcactccagcctgggtgacagagggagaccctgtctcaaaaaaaaaaaggcggggtgaggggggtgcagaggtttgttaggaataacaaaaggcactctgtactgctatcactcaggaaattcccaagggttttatgagttctataataagtcaggaaccaagaagaaagaccaaatgtatttttatcttataccttaatagactagtcatttaaccactctgtgccttagttttctataaagcgagggaaataaaagcacctatttaccaaggtggctgtgaccgttcagtgagaactattcctggtattttatgtaagagttaatttataagagttaattttttttatttgttgctatgtaacttatgtaactaccaaatggacacatttgatagtttttcttttttgcatgtaataccagatagacaactatagccttttacttgttttgaagtatgtccatgaagtctttagaatcttgttaaattatttcttaattttggtagggtaagcttcatatttgatctcttccatctctatattatataaatcagaaatcttgaatttctgctattctagtatctaggttttgtttcttttcttttttggcactactagttgacaagtgtctgtttccatggcattgtatatttcattattcagaaattgagcagtattttattcttaaagtttttcagttatttgaaaactattgaggtgctcttatattcatatatacctatagcagctacatagttaaaattatattagaggtttcttaaatggatttaaaatatacataaatatgtcttctctaatacctgtttttgaaaagaagcaatttacctgattgtgaataacttgatctttaataggttcacttcatattttatatgtatatataaatacatatgatatgaatatctatggcaaaagtttgtagcagtcgtgggctattaaataatactaataaaataaataataaataagcaaacataaaatcaatataggcccactaaaaagtaattctactaatttcccttttactttacatcgtagagtagttgcagttcttataatatctaacgtataatattgatgtgtcagaaaggaatttagaaatataatcctcgctgaattatatactgatttgtctgttttgatagttgtatctaaagagaagaagctgtttctagacacatttacctatattatatacatcaggattgccaatatttttaaatgaggtcagaagttattggtagaaagcacaaatactaatttgataaaagtaaaacaatgtaaaacttctcccttaaaatcctaataatgctttatagtcgatgattgtcagtaattagcttaatctgtaaagcacaaagcaaaattgtttgtggatgtgtgtgttgtaagaaaaaaaatgaaggatgaaaatgatgaataggatgaatgaaaaaaaacaatccaaagattttgtcaatgggtatgagctctagataaaatgaaaaatttaatcaacagatttctctccaggtctattaaaaatgagaatagaatatcaagtatagtaaagtttatcttctttattatatattttataggaatagggctatcagaattgattttcctaaattatgaatttgtttatatttttaggccctgcatcatagaatatggttcatctgatacttgcatgccttctagccttctccctgcctctaaatatgagatgctatcaaaacttacatatgaaagcatgataattctcactcatcaactttttagaattttgtcttgataataaaaactggtttttaataatagattgcttgcctttttttttttttttttttttttgagacagagtctcactctgtaacctaggctggagtgcagtggcatgatctcagctcactgcaacctccaccttccacgttcaagcaattcctgtgcctcagcctcctgagtagctggaattacaggcgtgcaccaccaagcccagctaatttttatatttttagtagagacagggtttcgccacattggccaggatggtctcaaactgctgacctcaagtgatctgcctgcttcggcctcccaaagtgctgagattacaggcatgaaccactgtgcctggccagatttcatttttttctggtccgataaaggttggataattcattggcactagtgaaatattagtaattataaagttccacagattatgaaactcatttctatacaaagtattttccctttatgtcccattattacttcaaagcaatgtatgtccaaaaaaggtattattacataaaggatctgtgtttgataatatagtaaattagaaaatgttaaactgttaaatatttaaaagacacaaaataactttcagtacttttagagcactaagctgtattgaattaagggttgtatgctaatatattattttgatcataagtaaaatagttgagtaaaagcctagcatacctgtatgtctcatccacttggtcatttgtgaagcttttgtttttaatcctcaatatgtgttcagtgccatgcttggtactgaagttaaaaaatgagtgagactttcacaggggtaagcaatgtagcccacaagccaaatccagcctgtcaccttttttttgcatgtccagggagctaagaatatattttacatttttaaatggctgaaaaaatcaaaaggagagtaatatttgtgaggtgaaaattatttggaatttgaattttagggtctataaatgaagttttattggaacaaagctacacttatttatgtattgtctatggctaaaacagcagagttcagaagttgtaaacaagaccgcatagcctataaagcctgacgtatttatcatctgatgctttgcaaaaaaagtttgtccacccatggccttttggatgacaacaagtcatctttactcacatttttttattttctcacttttacctttggttctttagtaatccgaataatgttaggtttccttccttatatttttaattttagatggagcaaagaaaaaatgcttttttgccatattgaagtgtattgcctcattgtttcaatagacaatatagcctaataaaaataaaatatcccttattctaaataatatatagaattctgcactttaaaaattaatacaatgaatttgttgtacattaagtaaaatctcactgttaaaaataattttaaactgagaaaaagtaatttgaaactgacattcttaggaatgcctcataacaaaagtatgctgatataattgatgattatactcaaacaaaagaagaaatagcaaaaataccaggaaactgtaaatttgacataaggaatatttatttaaaagagttcttataactgtttcattatggaagtgaagaggcatcagacaaaatgacctctttcaagagggaaaatactacaaaatggtaccaaagaaacctgacttaggaaaagactctgaattttagaaggtatattctgtttatagactacttttaggttgctttggggcagattaatatctaagcttttctacaaatttttttcacttaggttattagatttttttcatgaaaatgtcagttttctagtacaaattaaagaaagttacaaaaattgttttataatcaatttgttgaaatatatgtatttcataattttaagtgtgtgtttactataagacaggtattattttatgtagtcattagtcatttttctttcttatattgtaatgcttcaaaaataagaacactgtataagccctgggaagaagaaaaaattgacctaagttactaacaacatgttaatgattttcagtttgttactcttgtgaaagagagtgagaatttacatttaataactcacctaaaagttaatattggccattttcacaatcagaaaacactctcctacattttaacagaagcatagcaaaaaataccatatttaatcatttgtttttgatagaaaatttgattttgttttgagtaaaataaaatacctgttatacatggtaaggctaaaattagtcatattgaactaggattttgactatcttaaaattgttctatgcaaataggataatttaacaatattaaattgcttacaaagcagaatactagaaacccttatacctgaagtatttaaaactaaatttaataaaatgttccatccctctacagtcagatttgatggttatatttgatggcattttaaggagctcatcctaattttatgaaatagttcccatgtcatatctttgtctaaacacgttggcatgcaatatggtatagtggaaaaagcttacactatagagtcagattcctaaatttaaatattagtgctactacttactaactatgaaacttaaggcaagttgacctgttcaaatctgttttctcatctgctaaattagctaatttttctcatctgctaaattagctgatgcctacctacatctcaaaattgttgattctaataataaaaatagtcaataataacaactaacacttacatatagcaattactgtgtgcaaataactcttttaagcatatgttaactcatttattcttcaaaacaaccatatgaggccaggtgtggtggctcatgcctgtaatcccagccctttgggaggccgaggtgggtggatcacttgaggtcaggattttgagaccagcctggccaacatggtgaaacccatgtctactaaaatacaaaaaaattagccaggcatgttgttgcatggctgtggtcccagctactcaggaggccgaatcacgagaatcacttgaacccaggaggcggaagttgcagtgagcaaagatggggccactgcattccaacctgggtgacagagtgagaccctgttttaaaaaataaataaataagatatgtataaggaaggtactatttattgttatctctgccttaaagatggagaaactgtgacacagattgattcattgacttgcccaagacttttcaagtagtaaatggcaataaatgcatgtaaaaggatctaacataatgcctgtaatctttgtagatgctcagtatttgttctttttcttcctcatttaattaacagtactacctgttatctctaattagatatggtagctccaaatacttttgctactaaccattgtgcttctgatagctattgttaactacaaacataattggtggatatgtcttaaaaataaggacttgtcttgaaacagccagatatgtgaaaaaataactttttagtaatagcccactttatatctgggttttataattatttttgtattgtccactgaaagcagaatttttttttttgtatcataggcacacttaagacctttctgtttggtaagaacagcattcattttctttgttcaatgtaacaaatatttatgaagcaccttggactttatcaaacctaaagctaaagtacatatactcctaaaatagtcatatgacaattcaagacagtttaaacctggtaccagaaatatttagccaattcaggcaaaaagatttattcaaagagaaagattaaaagagagcttgagtaatgagtgaaatttttataaaattcaggctaaaattgaatgggatttaggttttgaaaaaggaagaccttaaaggtaggagtaaagaagaaggaaaatatatgagcaaggcacagagaaatacaaacataaaatctttctggctaaaacagagaattcactttacgtagaaggatggatacactagacctacattattttatttctttcagactggctagagaggtaccaaatacagaaatgagagatttactgtattagtctgttctcacatcgctaataaagacgtacacaagtctgggtaatttgtaaaagaaagaggcttaattgactcacagttcagcagggtgtggtaggccttaggaaacttacaatcatggtggaagttgaagcaaacacatccttcttcacatggcggcagcaagtagaagtacagagcaacagggggaaaagccccttataaaaacatcagatctcaggagaactcactatcatgagaaccatgagaaaagcatgagggtaactgccccatgattaaattattagtacctcccaccaagtccctcccattacacatagagattatgggaattacaattcaagaccagatttgggtgggacacagccaaaccatatcactgccgttattcagagattccttggaaacgagaattcatgagtctcctatcagccagtatagacagtaaaatcatgctttcaggactttcttagactcttttttgaatcagcatttattcgaatgcacatgaatacattcctcagtaggactaactttattctctttggaggttgtttttatgccctggttaaaaaaaaaaaaaaagttctgatgtaatctgcaaacctagtaactatccatttatttacttattaaatttaaactgctgagaggcacacaattccaattttgttgatttgttgtctggaaaccttttcagtcaatatttcccttagaatcaagaatcaagacaatcggaatatgtaatcatagatttgtcagtgctatatcttaattagcttagcatttgtataaaattacaaactttataatagtggagaaatcatagtatctcagagtttgaagagaacaaagaccttcatgttcaaagccctagcatgcccttttcatcattccagcctgaacatttcaaccatcacttcttctatcgaagagttcattgtttagacaactctacttgtttgaaagtctaaatatatcaaactgaaatctgtcaccttataatttctacccacttgtcctaattttgctcttggctgtgctcaaaagaaggttaattcctcctctgcatgacatttctgatatttgaaaagaaatgttatgtttctccttaagtccacttacttatggattatttttgcatttaatttttctaccaggcacagacttacccaaaacatacatcctctattttttatgcatgaaaaaagaaaagctccatagtaaaatggtgccagtataaaaattacaggtacaaaattagaccatttagataaataattagagcaataactgactttgcatttaagactgttaagttttgaaatatgtcccatcaatacctaatttattgagagtttttaatatgaaagttgttgaattttctcaaaggccttttctgcatgtattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaagggtattggtctaaaattctcttttatggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtctattcagagattcaacttcttcctggtttagtcttgggagagtgtatgtgtcaaggaatttatccatttcttctagattttctagtttatttgcgtagaggtgtttgtagtattctctgatggtagtttgtatttctgtgggatcggtagtgatatcccctttttcattttttattgtgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgtgagggtgtcaattttggatctttcctgctttctcttgtgggcatttagtgctataaatttccctctacacactgctttgaatattgatgggacatatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccgtgtctgcagatgacatgattgtatatctagaaaaccccattgtctcagcccaaaatctccttaagctgataagcaacttcagcaaagtctcaggatacaaaatcaatgtgcaaaaatcacaagcattcctatacaccaacaacagacagagagccaaatcgtgagtgaactcccattcacaattgcttcaaacagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgcctttcttcacagaattggaaaaaactactttaaagttcatatggaaccaaaaaagagcccgcatcgccaagtcaatcctaagccaaaagaacaaagctggaggcatcacactacctgacttcaaactatactacaaggctacaataaccaaaacagcgtggtactggtaccaaaacagagatatagatcaatggaacagaacagagccctcagaaataacaccgcatatctacaactatctgatctttgacaaacctgagaaaaacaagcaatggggaaaggattccctatttaataaatggtgctgggaaaactggctagccgtatgtagaaagctgaaactggatcccttccttacaccttatacaaaaatcaattcaagatggattaaagacttaaatgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagcactaatatccagaatctacaatgaactcaaacaaatttacaagaaaaaaacaaacaaccccatcaaaaagagggcgaaggacatgaacagacacttctcaaaagaagacatttatgcagccagaaaacacatgaaaaaatgctcaccgtcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaagacacatgcacacgtatgtttattacggcattattcacaatagcaaagacttggaaccaacccaaatgtccaacaatgatagactggattaagaaaatgtggcatatgtacaccatggaatactatgcagccataaaaaatgatgagttcatgtcctttgtagggacatggatgaaattgggaaccatcattctcagtaaactatcgcaagaacaaaaaaccaaacaccgcatgttctcactcataggtgggaattgaacaatgagatcacatggacacaggaaggggaacatcacactctggggactgttgtggggtggggggaggggggagggatagcattgggagatatacctaatgctagatgacgagttagtgggtgcagcacaccagcatggcacatgtatacgtatgtaactaacctgcacaatgtgcacatgtaccctaaaacttaaagtataataaaaataaataaataaataaaaataaataaataaataaataaataaataaataaataaataaaaagactgttaagttgaaagggtcctattccacacagtagcactaaagagggaagagtacattgttccttgaggtcagaatttttgcaattttgagaataaggcaaaaacaaaaatttcctatatgaagaacccacaaataaaaattatatattcaatttcctttaaatatatatcctaattgtatacctactctatgtcagaatatgtgctcagcttttatggggccctatggatacgagagatcatatgttaaataaacatacaagcaagtgtagatgcaagtgatggtaagttctgtttctaattacagttctaactagaaaaatagtgttgcccatataaccttttatggagtagcataacatactgcttaattctgctctgtaatggggcataaaattaataataataaaaataacatagtggttaagagcacagactatttgggtttgaatcttagatccacctgttattagtgtgcaaccccatgcaatttacttaactttaaaaacctgttttcttatgtgtaaaatgatagtaagagtacttgcctcatagggtacttacgttatgtaaataatataagcaaggcactaaaaacaatatttccttgctatataaatctttgctattgttatctacaatatgtttagaaagagctttagctttaaaaataagtagatgatggtggaataaatattataagaattattctctgaaagaaaaatcaaacaagatagaacttaaagtacacaatagtatagttgcagaaaaggaaaaagaaatatcaaagaagacatgttaaatccttgttttagcttgaatttatcagtgatgatatcttgaaatcacctttccagttcacccttccaaatctactcttgtaaaatgaaaagaggctagcataccagaatactttggttttgcaaaatatgtgctaagaaattaacaacaaaatataaataaatattttgcagatatattagtaaaatgctaaaagtatatttatctagagacatagtctaaggaatgaagatttcaggatattcctttctttactactgtctggaatcaggaatatggatttctctctctgtgtattaggtatccatctatgaaatggacttactgttgcctttcacataaaatgtaataagatgacaacaaatgagtactttatatctgtcaagtactatgaacttctcagaataatatcactgaattagaagggcagaatatttgtaactttgttgttactgcctgccataaaaggcatctgatagggattcagaaagtagattgaggcaacaaagtaaacaatttgaataattctaataattttaccagtattattttcttatattgaaacttggaactgctactaaaatatgaaggacaaatgtccactggaggtagtaaccattttagatatttattaatggcacatagatgagaattagcagaaaggatccaagttccttcaaaagatgctgagaagaaagaagcagtaaacctctcttgtatgtacagtttgaaaatgatggttgtcagtttcactgaatgaacgagaccgaaggccaaaggcaacaatgtggaagaagcagtccatcatgctggaaggactaattgatatacaaagaaataaattatacttctctatgaagaatgaagataacattatagccatgagtgccactgggataatttaagtgtcttacccctcagcttcttcactcctttctataggttgtattgcagcaaataacataatatccttacgtggaataatcctcaggctaaacctttatggaaagaaaagctaggtcagttttgattaggaggtgcttctgaatgcagttttacaaaattttttaaatactctttttttacaaaatggaggtatttgaaccagagagaatataattgttagttttgaatattgtataactataatggagtcttattataatgtgtcaattgtctgctgtgattcaagattacattgtataggcaaacccattataatgaggtcactttaatacccccattgatgagattcaaaagaaattcatatcatgctaatttctgactattgttagggtatgtatttagaagtttagttaattgtgtgatactttgatataagtttccatttatgggccctatttacttcctctttcattctctcccattttgccattttcaagacttactggtattgtactttgtccttcgagatggcgctgctctgtggggtagatagatgaatgaatatcaccctctttaataaataatatttagaggaatgagaggttacttgtatataatattgaaagcaggccagttgtggtagctcatgcctgtaatcccagcactttgggaggtcaaggtgggcagatcacctgaggtcaggagttcgagaccagcctggccaacacggtgaaaccccgtctctactaaaaatagaaaaaatagccaggcatgatgacatgcccctgtaatcccatctactcgggaggctgaggcaggagaatcatttgtacccagtaggtggaggttgcaatgagccaagattgcgccactgcactccagcctgggtaacagagcgagacactgtctcaaaaataaaaaataaaactaataataatattgaaagcaaatcctagtataagtatacattcccccaaacatttaccatggacaatagtagcagcaatattaacagtaaattctagtctatctttgctcaaattttagttattgctctttgccttctaaatataaaatactataggacaggggtcagcaaacctatttaaaagggccagatggtaaattttttagattttgtaggcatatggtctctgtcaaaactacccaactctgccagaccggtagcacagaggcagccacagatgatgtaaatgaatgagcctggctgtgctctaataaaactttattacggccactgaatttggatttcatatatttctacgtgtcatgaaatattattcttcttttgattatctcttgaatcattaaaaaatacaaagatcacttatagagtgcaggccatacaaaaaaaaaaaaaaaaaacaggaaatgggcaggatttggcccttgggctgtagtttgccaacccctgttttagaacattcctattctatagtacactggcgtctgctctgttaatcttaaagctcatagtatgtgagctttcagaagaatactctgaaaaattgagattgagagaggaagccccataagaagttaatgcttcatggactcaaatatgtacttaaagcctactagatagatatagatatagatatagatatagatatagatatagatatagatatagatatagatataggtatagatatagatatatacatgccaggcactgtttaagatgttgagatagagcaatgagttaagaagtcacaagtccctacctttatggaatttacattttagtgagaggatacaagctattaaaaaacaagtaaactctatagaactggagatggtaagcgctatgtttaaaaattaaccagggagggaggataggtagcccaggtaggaaagagggttataattttaaatagggtcatccattaaggaaggcctcattgataagatgacatttgaacaaagacctaaaggaggagagagaggaagccatggatcatgtggaacctgtatgccacccttagtgtaacagagtagaggcatggcatgaactgacatattttaatgggaaaacaagttaggagactattaaaataatccaggtggaaaatgacagtggcttagaccaatgatagaggtggaggtagtgagaagtagattactgatatattttgaagggagaggtaaacagatgcaataagataaagagagaagtcaggtataagacccaagatttgccttgggaattagaagaatgtagtttccatttactgaaatggagaagactatgggaaaagtaggtttgagggggaagatcaggaattttactttggttatggaaacctgaacttcctttagatatccaagtggagatactgaattgcaattagatattaagtatatgaggccgggcatggtgactcacacctgtaatcccagcactttgggaggttgaggtgggtggatcacataaagtcaggagttcaagaccagcctggacaaccgggtgaaaccctgtctctagtaaaaaagaaaagaaaagaaaagaaaaaagccagacctggtggtgcacgcctgtaatcccagctactcgggaggctgaggcaggcgaattgcttgaacccaagaggcaaggtttgcagtgagctgagattgcaccactgcactccagcctgggtgacagagtaagactccttccccccgcccccgccccaacccccccagccccgcccaaaaaaagtagatattaggtatatgtatctagacttcagtaggaaaatctgggctagaaatattatttttggagtcatcaacatataaatggaattaaaatccatcacaattgatgagatcaccaagatatttactggtattactatttgttgattgatattactgcccctgattctttctcatccactttcaaagaggtaggtagtttctagtaatctgtcccctctgctcattcacaaagagtggaagggatcccactgaattagaaacccgacctacacaggaagtaccattagttgaccatcttcccattttgccgtggtgtaaacatatgagtgaatttttccaagtacctccttgctggaaactgtttgcactggaggtaagtgtgaaaggggaggttgtggggaatgatggggtgagggctgcctaaacttttcccataactcagaaatggtttcattctgaggaagggagaaggttcaggctggttcttatttccctgaaccagtttgtacagccctaaatttgacctgctttcctcaaactgggagtcagaaatcccttttctcttctgtttttctgctgcagaaattcccaacattcccattttgtgggctccagaaaggggtaagcgaagacttcaatcccagccaatcattttcagattaataatttttagtgttttggtttcttttatcatcataaaaaatgcttggatccatttttcacatctgtttaatttccttgtggattgttatgtatctatgttctagggtcattctgtatccctgggcaatagagttcagatccatctgctatttccatttgtgtgctgttctcttgtggattctcatttgcagtttattgattactgtatcctagatggaagacacccaattcaggggactgcctcactctcaatctcatcttttcctgaatggtgttttattcctctgctgagagcttgctattacactacccaactgcttctgatgatctgtcattgtttctctactgttctgtcttcctgcttgattgcctttggtttttgtctctcctttttgcctcacttcactcatctgctgaatgatttgcattcttcactcactggtgctttgtccgtcagcaaatggcctggtactgccatatccatctgctattttagcattttagactgcccagcattatctatctgctcccctacaattcccctatactatggcctaacaagtgctatgccatctgcctgcctgatcttgccctgcccaatctatgcctgtaacactgtaagtaggtgagattgtttagcatttctgctatcatctacacttgccttgtgccactgagttagactgctgactgagttagactgctgactgagtttgcttgactgttgcctcctctacctatttgctacctatggctgccccattaatttatttgagatattgaaatcatctcctttgtacttgcaacttgctgattggcctgtgttgcctcctttacagtttgctgcatttaaaaaatcactggcattgctcctctgttgtcttgtaaccctgatcatattttatttccaataaaagttttgcctacatatcgtccaaacatcttagaaataggaaaatgctttgctatctaacagcccagtccagtttgctcctaaactgactttttaaactaccacctgtcctttctgcttttttatacagctccatattcttctctttatgtaagaatatatttttttataaataatcatctttgcttaagttttcctttcacatcatatattatgtacatttatttcttgtgtatgggatcttttaataattttccatatactaaaattatttcttaatttattattcctaaattttccagggttttataaggataagttactcctattaattttatcctttttaataagaccagaagatttttttgcaactttaaaagcatcatctctaaaaataaatttaattatcttataattctttgtagtttagattaaagtagctttctgctctgctctattttttcctttgagaatatcatttctcagcttcctcatagtttacgtaataccagttctttagagatcctttagatgtatttatcttccttccttttaaactcttttcttgtatgttgggtaaacctttgaaattgatattttctcattattgtatttgcaaagtacttggcatctaaaaataacttgcaacataacattatctgcactgtaaaacttacagtcttatttgcttatatttaaatgaaagctcaaatacaagaaccaaagaagaattttggtgaaatttgcaagagtctaaggaggagatgtaaagtggggtgtgtatgtgtgcatgcatatgtgtatatagagatttgaagtgttttatgtgtgtatctacaatgtcattgtgctcgaagtgtggaaaatgctgagtatccatattaaattttatttttacaaaaaaatctaaagaggtgatagatttagggatacggaaaaagtatggatgggtttttattttcttttaataatatagataaaatttgtcagtgtgaagaaaaaggatgctctagggaagttaaaatcatttcagtagctttttaaaattttggtaaaatataaacataaaatttaccattttaaccaattttaagtgtacaattcagtgatattagcacattcacagttttgtgcaaccgtcaccactgtttctagaacttttatcatcccatttagaaactctgtacccattaaacaaaaactccccattcctccctcccccaacccctggtaaactataatctactttctgtctttataaatttgcctgttctagatacctcatataagtggaatcataccagttttgtctttcagtgtctagcttatttcacttagcaaaatgttttcagggttcatttatattatatcatgtattagaatttcatccctttttaactctgaccattattccactgtatgtatataccacaacttttttatcagttcacctgttggtggacactgggttgttttcagcttttagcttttacaaataatgctcctacaaacattggcatgcaagtatctgtttttcttttggttatataactagaaatggattcaatagcatttaatactttagtccaagaagaaattaaattaatagcaaagagatcagggaaaccacataattaatatgaaagattaataagtccaagatatgatattaggagcagaagaaattataaacttttagaaaggctacagaaggccaaatgataaaatttagaagactattctatgaataaaagggagaatgaagttaaaatgacacagatcttggatgattgtaagaaaacaaaaatgattctgaagaaagttaaattttaaaaaaataaccaacttaaggacagtatgatggcacatctttgaaatggaataatgtgggcttttatagaggagagaggtaggcatttgaaaggcaaggtttaaatgaagatgactaagatgagggaaccaggtcatgtttagaggaaccagcaatgggaacaggaattcatttcaatccagagatccttcatcctgtatactcagccttctaccactcatagacatttttctaaaaagattgctaggctcgaaccccagagattctgattcagtaggtttggaattcggtttaggtaatgtgcacatacatgcctctgtgtgtgtgtgtgtgtgtgtgtgtgtgtgtgtgtgtgtgtctgtgtgcgtgcgcacacgtgaacgtgtgtctgtgtgtgtgttttaatccactgatgaaacacaatatgagttaaattgaactctgtaccgtagtggcctagaccttataagaatttaaaaagttaaagagaattgacccttgtcttcaagcagtttaaaactgcagtagttaaaaaatgatggacttaggaaagcagtttaaaactgcagtagttaaaataatgatggacttaggaaagaagactttcaatctgttaggtgataagttctcatttgttaattcaacaattttagggggggtgatttttatacactctatccatcccttctcaattgaggttccccatctaaactatcaaacacagaaaattgtttgactgtcttctcaattctcctaagggtggcacaccagctagtaccattctatatgtgtgagagataagttaattcactagatacaaaaattctctcagaaccttttaagaaaggttgggtaatctgtagtctgctaggaatatgtgacacaaagacataaaacgtggctcttaaggtgctcacattccaagagaggggaaaagacatttaacaaaaaaaatgcatttctaatatcaaccacacaattttgttcttttcatctaatggtttgaggaaaatgttcaaagtcacagtggctgtatataaggaaatcctttcacctcttctaagcattatttattcaggaagaagaatgtaataagaatgataaagtctgtattacaacttatcacagctgaaggatgctggcagtaacttaaatgtcgataggaatctctttaattttaaagcctagagcattcagtgacaggttagtgatttcattggtagctattaataaataacagtaactaaaactaggcttattagtttcatagtaaagagtagaaaatgggtataggtaagtagataactaatgtccaataggctgttcttgaatgtaattgcaagcacagtgagagatttttgcccccgaagtacaactcttataccaataatgaaaatgttcaggaatttaatttattctcactatcaattaaaactcactaaaattcctgctgtcagaaggtttagtcatattcattagtttttcttacggatttgattatttctgaactataaatttatttgtgctccctatactgatttgtgcatttaaacttgagagcagttagctttcattcctattactcagtacttcacactgattcctttaggataaactttactaacacatttttccttcttccttccaatttcttaccaaactttattttaacagcacagctatggaaagatcaaggttgtcatgttgagaaaagcacaacaatagaaattacgaccagatttagcttgttttcttagcaataatgaacaattttaaaagattttgctttgcctgcattcattctgaaaaacattttaaagcagaaaaagcagattatgccgatattttaataaggtggaataaaggaaaatataagagtaacataattttattaaactcattttattaataataaatatactttttcttatcttatgatctctgaactcctattttattttgaggaagctgaatttaaaatagagtgctataacgtgtttcctttgtgtgaaagttaatctgagaaggcaaaaggtctatctcattcttactaggcttcaagtcctttatatctaataacaagaaaattctctaaattaggcaactactccctaacaaatcatctattttttcttttagttttttattttctccactgaatgacagcagaatgtattcaagaccttgcaaaggatatggctgaagatgtagcttccttatataaacattttgtggaggtttccataaaatgaagtgaaacttttgtgaagtttcactttttttattttgaatatagataataacagtagcaggcactaataatcagtctcctagtttcttaatctctcttctccccctatttgccctcctaccatcaaatacttcactgttgctggcagaaactaactcatggcacaagagatcaggtgggtgagaaagagatcactgggggaaagtaaattgccccagaaagactgtttggtgcaaagatccttttttcacatgtaacaatctttaattttatgaacatcaaaatcaatacctgaaaagtgcactagttagatatttggaatttttcaaatacaaaccaccaccagactttttgtatttgacttagaatgctttttagatttcttataatatttagtacttatgaagaaatttagtgttttttacttatatcagcaacataaaaactgctcaaatttgattcctcagatgttcaggaatcaaattttctttggtttattcatagccgtagtagtacatgtatatttgcattgtaatcaaaggtggtaatcgccctacagagttcttaagcagaggtcctcaaagaaaatactgtatctcttataagttaaattattttctcatccaatgctttctgatcaaaattaagatagactctgtcagagggataaaatatgaagtctgtttagatatcctgcttctcatgaaggttagtaactacatggtaaggctaaaggccatctgtagaaagcttctcttttaccaacaagaaaactggttttcaaatttctcgttactttctcgttagtgttaagatattaggagcacaccattttgcatatgatatgtgttcaactacagcataaaatgacctttttattgtgaaatgggtattcagtccatattgtaatagaaaaatatatggtcatttaggagaaggaaaagatgacgttcatctttttaataacagagttttaaaataactccttttttactgaacatggaaataatacatgctttttgcaagaaaaaaaagaatttggggaaaatatagcaaagcaaaatgaagttaataaaaacaccaataatctgaacccacaattattacctaagactaattcattaatttgcccaactgggagcacaccatatatactggtttatatcttggttttcttagtaatatcatcccaattattataataattactaaaatgtatagtacacttactgtatgccatgtatttttataagtactttgtatattatatctaatttaatccacacaagcctacaaaataggtaggtaccactttacagataagaaaattatatttagaaagattaaatgattaaataaattgacttggatgtagcaaaagatgatagaactagaatttgaactaggtagtctttactccagatcccttgctcttagccactctccttttcatataatgtaagcttttcttcatttaataactgttctacaaaaaaattgggatttgtcaatcactgaaaaatacttaaaaactatgagtaatttaatttccctatcattaaacatttaggttctttcctatttcctatcacattctctttgtataaattgttatgtatacttctaatgatcactttagaaatatttcctaaaatacaataactcactcaaaattgtgaagtttcatattacatattgctaaattaccctcttagaatatgtacaagtttatgtatttgtactatcagtttatgagactgtatttccattaatcattgttaatcttaccaatctggtaggtgaaaaattgtatttttattggcatattgtagaatattaatcatttttaatcttaccaatctggtaggtgaaaaattgtatttttattggcatattgtagagtaatttaaacactgttcttgaatttattcagttttgtttctccttttataaactgcccaggttttctgttttgttttgtttttggctcagtagctgttcttaaatactgattgtaaccacaaagaggagtgtaaagaattggttgtcaagaaataattttggtaaggtcaaatttatgttttggctgtatcattttgacatataaaccattcattttctcatttctcaaactccgttaacataccagtactcaattattttatcactcatgctcttaacaacacagatcaagccaaaaattatatcctgaatcaaaggcattaagttaataaaatacaaacacatttcttcctaataagttagtttttccctttgtgagattttttcatggctgatgcatgatagtttatgttctaactatccttttcttatgtaatgttcactgttaaataatttacagatagaaacttattgaacttcagtaatgtagaattaatggtctattcatagatataagccctggaaaataatgtataatttggacttttaatacacttagctactattagcagtcattttaaaaaataccaaatataaactcttacacaattattttgcttggcaaactcatttttctatataggaattccaaaggagacattattctagcatgcaattaatatgaattatatttgattatctagatattgaaaccattttataaacttctctgacatgtagagctcaacttcctcttaagcattcaagagaacctatttttttttagttgcccataatatgcaaaccatttcagaacccagagatttttggtgagtgaattaacatgtagtttgtatttttacatggaaactatatgtataaatggttttcaaccagggtaaattttggttccccagggacatttgcaatgcctggtgacatttttggttgttacaattggagggtacctagtgatatcaggtgggtagagcccaggaatgctgctaaacatcctgtagtgcatgggacagtcccggcaataaagaattatctgacccaaaatgttaatgcagagattggaaaaaccctcatgacataatatcgagtacgcactaactgccaggttgtgctggaggctgcgggtacatgggtagaaagttatgatcttactggttaggaaagttacatttcattgtgaaacagaaagatctagattttttaaaggataatttaaatgataatgagattttaaaaatgatatgatattaacatataataatgtaatataattgttatgttaatataatcacattttgttataagaatatataattattgtgctgtggtaattttatgtgtgataaatatatgacatatttaggaacaaaaattctgcctgagggacttacttagttttgggaaactttcaaagaagtgacaagtgatactggcactgtttttgttgttgttgtttttattccttaccttttatttaatttacaaaaaaaaaacccacaaatagtaagttacaccataatggattttcaaaaactgaacatatctatataaccatccagatcaagaaaccagaatattatcagtgtcccagaaaatggcccttgttcccccttacagtcacagctcaatcctcaagtgtaactacaactttgacttttagcactacagattactttttttttttcaaagacaggagctccctctgtcacccagactggagttagaattacttttgtgttttaccgaactttgtataagtggaaccatataatatgtaatcttttgtgtctggattcttttgtttagtgtcatttttgtaaaattgattcatattatttcatgtagtgttgttcattctcataactatattgtataatacagctatatttattaacccattctactgtaaaggcacaatggctgaaaccgttaagttgacaaataggtcagtttggctgcagaatgggttttgagggagtggcaagagagagctgggaaaagtaggtaaggtcagatgatggaggatacctttgtcatattaaaggcatttggatttttttttctattaagaaatgagatttttcaaaagatattaaacaaggggaaaatataatgagacttgcattttagaaagaccattttgacagcagaatagaatgggttgagtgggagcaagcttagctgtagcaccaatcaggaggtcattggaatagttcagataaaagatgctgagaacctagaagtagacagtgtaggtggggatagaaagggacatatgattttctctggatagaattaattgcacttttggaataactgagaataagggttgcaaagactagttttctgagccaaccttcaaagcccgtgtgtattactaaaatgcaaaatgtgtgcaataaagaaaaataatagaatttaatgttagaatttaaagttgaattcaaaataattttcaaatgtatctttaatgtttgaacttacagaaaaacagatatcattagttgagaataaattaataaaaatctttatggataatctgaaggaaacttggcaacagtctagactaaaggttaatagtactggccacttgtttgttttcatttcaatttttaaagtatggctttctcttttgttgtttcaggatatcactcatggtacattttgccactattacggtagctttcagttgaggagggaaaaaaatgtgtgtgtgtgcgtgcgcgtgcgcgtgttcacctgtgcacacattcacgcgctaaatgcaggagttgagagaagaaaggaaagggggagttaaaatattgcatatggatgaataagaagaaaagtgtcttaagcagaatgaacttagttccctgttattatttctgggtggggaaattgctctctctttttattttgtttgtgcatgcatgcctaaggagaataaaggcactcagaaagttcccccatagtcaccgggtgatagcttcatttcaaagatgtatcgttttctatctgagacagtagtcaagctaattgtctctttgtgacctacagaatgccagcaattagcttttgataaaaagaacagtgcctatcaatgttttcaaagatgaagaattctgacataaaaaataaaattagtgaactctcatttgatggtaattacacctgttgtctattgactaaagcaaatatgtgatactttttaaaattatggtcaattctgtaagatttttagatgaatttgtatcttattataacatctatattcattaaaagctctaatacacataaatgagggtaatttattcattgtataatcagtgctttttgcattaattggtgaaaggcttctaattgctctgatatacctcagggtctgtcctccacaaatgaagaaccacaggcacttgatttttttgtttgtttctgttgcatttggggaacatctgtattaggtccaaattttagtgaattctaaattttatgctttcaattaatgattttattgtagatttttaaaaatcaagtaaagagtaatctttatactaatttattttgaaaatgtcagattttgaaaacaacagaccaatgtaacactgagtaaagcacatctgcatttttaatttttaggaagaaatatggattccttttcttgtcacatttattacttaaaaaaaataaagtatgcctgttaatcttcaacacagattcaaagatgagaatagtatgtattagtctgttgtcatgctgctaaagagagacatacctgagactgggtaacttataaaggaaagatgtttgacacacagttccacatggctggggagacctcacaatgatggctgaagacgaatgaggagtcatgtcgtacttggcagcaggcaagagagcttgtgcaggggaactcccatttataaaaccatcagatctcatgagacttattcaataccacaagaaccaatgggggaagcacccccatgattcaattatctccacctggccccgcccagggcacaaggggattattacaattcaaggtgagatttgggtaggggcacagccaaaccatatcatactataatggcaaaaatttaaagaatcaaggagctaccttgctttgtatttgcttctacttttcttcatcagttttatcaaaaacagattttggcactgtatttttacctccataatttgagtttttactgaaggatccttgagagtattaaaagcatggcaattagctagaagcaagagttctttttctattttgccgttagtttatctgccatattccttatcatatcattttatcaccaaatgaagtcctaaaatcaacaaatgagaaacttttaaaagtactttgacatcatcttgtattcaatcaagaaaatattgagactttactagttttaagtgagaaagaattaaaagtattagttgtggcaaagatttagtcccttaacccgaatatttgttaaaatcaaagaacaaaataacctatctaatcactgcaaatcattcttatctaaatgttgccatcacaggagtagccaggtatcattagtgtaatcttcagtctcaatacccttcagtcatgagtccaataactcaaacctcatttcaagttcacattccttttatcccaaataatggaaaaatgggaagaatagtaccctttcttttttgtctaagctattaactgcatatgcctgaatggaagatgacagcaactataatatgagacacctattttcccaatgagaagatccataaatggggggattatccatcttaaatgtacatacttttagcaatttagataaaatagtggaacacttaggttaactaatttaaaacacaaatataaatttaaagccacattgaaaatagtatattatttaggacaactgattctttttcatggcaattttttgaaaggtgttatgcaaagtctcaacatataccattaacatcaatgtctttattatcatttccagagtctaagtaatttaaaagttttccatgctatatcatcttttgtttaacagctctattgagatataattcacatatcatacaattcattcattgaaagtgtaaaatttaatggtttttggtatattacatttattttctaaattgtggcaaaatatgtatagcacaaaacttgctattttagcctttttttttttttttcttctgagacgtagtctcactctgtcacccagactggagtgcagtggcacgatctcagctcactgcaacttctgccccccggattcaagcgattctcctgcctcagcctcctgagtagctgggattacaggtgcgtgccaccaagcccagctaatttttgtattgtagtagagacagggtttcaccatgttagccaagctggcctccaactcctgaccttaggtgatctgcccaccgcagcctccctaagtgttgggattataggcatgagccaccgtgcctggccctaatttagccatttttaagtgtacagttcattggtattaattatattcacaatgttgtacaattatcactactacctgtttttaaaactttttcatcaccccagaaactctgtaacctttaagcaataactccccatttcttccttcccataatccctggtaacctttaatctactttctatctttataaattttcctattgtaaatatttcatgtaagtgcagccacacaataattctccttttgtgcatggcttttttcatttagcctaatgtcttctcagttcatgcatgttgtagtatatatcagaactttattgctttttatgcctgaataatattctattatatgtaataccacaattcatttatccgttcatcttttgatgaacacctgggttgttttcatcttttggctatggggatagtgctgttgtgaacattggcaaacaagtatatgttcaagttcttgctttcatttccattggttatgcacttaggaatggaaatgtgggatcatatggcaattctgtgtttcacatcttaagaaattaaactgtttaagagttttatggttttagttcttatactatagataaagaactatagttctttatactatagatctattttgagttcatttttgtatgtggtgtgaggtacgagttcattcttactgcttaattatgaatacatggaatttaaaatttttctatttaaagatattactggaaatgttattccaagcctgaagtagccatttgcctaacattaggacacttaccattttcttttatcctgtaaagatatcctaacattcacaatataaccacatacaatattgctttttattaattatttctgacaggtatcttttatatccaaacaacactagtattgatgaagagatcttttaggcttgtgggccttcatcaaacagtactttttgatttaaaaaaagtgaattcagtaaaatatgcgaggccttataacagttcaaatgtaaggcaactaactgttctttgctgatgagtaactttggtttaaaaaaataacttgccatatggaagttaagatgtgggaacatgggtttgattttgtgctattcatgtatattggaggtgatctcaactctgtgctaattcaaacaatttatatttccaggtaaaaataaactttagaatttgtagaaaattcatatgctagtgttgcatcctgaaattattatttgtctccaaattaaagtgaaaagtgattcaatagagaaacaccttgattccccatatctgtcagttgataaagtagctattgcagaattctacaacagagagaaggaagagtgagatagtaaatagaagagtagcgtttatgagttcaattaaaactttaaagaacagataattcctgtcttatttcctcattatttaaattgtatctaaacacaggatgaagaaaacatctgaactcaatctataaagataacaaaaccttcataccaaagtggaataaaaataacaaggagactatagacctaatcatatgtgaaaatatatgtagaaatattgaaataatatgcaaaaacttgatacagcatcaagttttttctaaatgtacacctcttcctaagcgaaactgattttaagaattcaagaacggtaaattttagacatcctttaatttcatttttatcattattaggtaaatcacaaaagattatatggtcatcttgatgtatgccaaaaagacataaaattcagtgtatttttttccttctaaggatacatagtaaactagaatgaaagaaaaattttaaacatggtaaaatgtgtttatcacaaaaaccaacaaatacaataaagctgaaacactggataaattcttactaaagacagaaaaaagaaaaagatagttacagtcaccattatttgttctagaaagtctaaccagcacagacagtttgggcagtcagtaatatgtgtcaaaaatttgaatgtaatgatataattacatagagagattatatgatggaaatatgagaaaagatatgaagaatgaaatgagaaggtccaaagtacattatatcagagccccaaaaggaaaaaatagaaagaataaaggcaatgatcaaagagataatgactataaagtttacagaactaatgaaaaaacacaaatccagaaatcctaacggtatagtgtatctcaagaaggataaataaaagaaatatgtttctgaacacatgggaatgaaatgtcagcactaaagtaagggaactattgaaagtaaccagggagaaacagcagatcacttacgtagaaatgacagcaggcttttcgacaacattggaataaaacagacaatagaacatgtaaagcattgaaggaaataacgagaattgtttattaagcaaaatatctttcaagaatagagataaagagggagtaaagcaagttggccaaataaaaggctccaccagtcataccccaaacaggaacaccaaacttaacaactctccacagaagaaaagcatctttatcaaaaccaaaaaacagatgagcagttatagtacctggttttaacttcatgttgctgaaggagacactgaaagggataggaaacacagtcttgaattaccaacaccacccctccccagtcataccccagcagcaactggctgcatggcatggagagagaatctgtgcatttgggagaggaacagcacagtgattgtgagacgtagcattggacacagtgctgccctgtcacagcagaaagcaacaccaggcttaactcaactgaatactgcccatagagggaccatttggaccagccctacacagaggggaaccactaatccctgcgattggaaagtgagttttggcaagccttgccaccacaggctaaagtcctttgcagcccaaaataaatttgaaaggcagtctgcgctccaagaactacaattcttgggcaagtcctagtgctgacctgggctcagatacagtgggacgtgggggcacatgacctactaagacaccagccaggacagctaaaggagtgcttgcaccatcccttccccatgcctcaggccacatagctcacagctccaaaagagaccccatgcttctgcttgaggagagggaacagtaaaggggactttgtcttgcatttggaaaccagctcagccacagtaggataggacaccaggcagagtcatgaggccccctttccaggccttagctcccggacaacatttctaaacacaccctgggccagaagggaacctgttgccttgaagggaaggactcagtcctggcaagatgcatcaacttttgactaaagagaccttggatcctccaaggtccagcagtgatacccatatagtatgccatgtgccttaggtgagcctctgagacatgctggcttcaggtgagacccagcacattcctagctttgatagctatcgtgagagactctttctgcttgagaaaagcagagaaaaagtaaaggggattttgtcttgcaccttaggggagtagagcaccaagtgggctcttggggacctgatttcaggccttggagcttggacagcatttctgaacctgccctgggccacaggggagtccactgccctgaagagtgagtcccatgcctggcagcattcaccacaaactgactgcagagcccttgggcctaaaggaaacatcagtgttagcctgacagtactccccttgggtctgttgtggtggtggccataaggtgaggctcctctgcctgtggaaaatagagggaagagtgggaaggactgtgtctcatgatttgagtgccaactcagcttcagtaaaatagaacaccaggtaaatgtctaaggttttttttaattccagtccctcgctcccagacagcatctctggacctaccctgggctgggataactcaacaccttaaagggaaggacacaagcctgtctgacttcacatctgttaatcgtacagccttagtgccttgattgaacatagacagcagccagatagtggttacagtaggccttgggtaagacccagtgctgtgctggcttcaggtctgacccagctgacccatactactggtgatggccactggtgtttgtatcaacccaccatccccagctccggaagcacagcacagagagagactccatttgtttgggagaaaataagagaagagaacaagagtctctgtgtggtaatacagataatttttctggactttaaccaagaccaccaaagtggtatctctgcaagtctgcaagaactatagcattactgggcttggggccgaagtcccttcaaatacctggaaagcctttctgagagagacaggtgccaacaagcccagattgcgaaagctaataaatacctaactcttcaatgccagaaacactgacaaacatctacaagtatcacgatcacccaggaaaacatcacctcacactacaaactaaataaggcactagggaataagcttgaagaaacagagatatgtgatcttttagatagagaattcaaaatagatattttgaggaaactcaaattcaagataacacagagaaggaattcagaattctgtcagataaacttagcaaagagattgaaataataatttaaaagaaacaaacagaaattctagacatggaaaatgcaattgacacacccaagaatgcatcagtctcttaatagcagaatcgatcaatcagaagaaagaattagtgagcttgaagaaagactaattgaaaatacacagttagaggagacaagaaaataaaaaaggatgaggtatgcctacaaaatgtagaaaataggctcaaaagggtaaatctaagagttattggccttaaagaggaggtaaagaaagagataggagtagaaactttattcaaagggataatatgagagaacttccaaacctcgagaaaaatatcaacattgtgcaagaaggttatagataacactaagcagatttaactcaaagactacctcaaggcatgtgaataattaaactcccaaaattcaaggataaagaaagaatcctaaaagcaccaagagaaaagaaacaaatgacatacaacggagctctactacatctggcagcagaggtttcagtggaaaacttacaggacaaaagaaagtggcatgacatatttaaagtgctgaaggaaaaaagttttgctctagaacagtatatctggtgaaaatatccttcaggcatgaaggagaataaagactctcagacaaacaaaagctaagagatttcatcaacaccaagatttcatcaacaccaaacctatcctacaagaaatactaaagggagttcttcagtcttaaagaaaaggatgctaatgagcaataaaaaatatcatctgacagtgcaaaactcactggtagtagtaagcacccagaaaaacagaatattttaagactgtgattgtggtgtgtaaactactcttatctcaagcagaaagactaaataataaacgaatcaacgataataaccgcaacaacttttcaagacgtaataagacataaagagacacaacaaaaagttaaaaagcggggacacaattaaagtgtagcatttttatgagttttctttttgcttatttgtttctatatgcaatcaatgttgtcatcagtttaaaataatgtgttatagtatttgcaagcctcatggtaacttccaatcaaaaaaacctacaatagctacaaaaaaatatataaagcaagaaattaaaacataccaccagagaaaatcacttccacaaaaaggaatacgggaaggaagaaaagaaggaagagaagaccacaaaacaaccagaaaacaagtaacaaaatggcaggtgtaagccctttacttaataataacattgaattataaatggaccaaactctcaaatcaaaagacagagtggctgaatgaatgaaaaaacaagactcaatgttctgttacctgtgagaaacacagttcacctgtaaagacaaatataaactgaaaataaaaagatggaaaaagatattccatgccagtggaaaccaaaaaagagcaggagtagctaaggcaaaatagttttctaaacaaaaactgtaagaagagacaaagtcattatataatgataaaagggtgaattcagcaatgaacccaatgctggagcatacagatatataaagaaaatattattagagctaaagagagagatagattccaatacaataataactggagacttcaacaccctactttcagcattaggcagatcatgcagacagaaaatcaacaaggaaacatcagacttaatcagcactatagaacaaatggacctaatagatgtttacagaatattttatccaatggtggcagaatacacattattctcctcagaacagagataattctaaaggatagaccatatgttgggtcacaaaacaagcctcaaaacattcaaaaaaattgaaatgatagcaagcatcttttctgaccacaatggaatacaactggaaatcaataacgaggaatgttggaaactatacaaacacgtggaaattaaacaagatgctcctgaatgatcaatgggtcaatgaaggaattaaggaaactgaaaattttcttgaaacaaatgaccaaatatgccaaacataccaaaacatatgggacacagcaaaagcagtactgagggaattttatagctataagtgcctacatcaaaaaaaggaaaaaattcaaataaataacctaatgatgcatctcagagaactagaaaagcaagagcaaacaaaacccaaaagtagtagaggaaaagaaagaataacgatcagaacagagataaatgaatttgaaatgaaggaaatacaaaaagatcaacaaactggaaagcttgttttttggaaagttaagcaagattgacaaacctttaaccagaataactaagaaaaaaggagagaagatacaaataaacaaaatcaaaaatggaaaaggagtcattacaattgatactgcataaagtcaaataatcattagtggctactatgagcaactatataccaaaaagttagaaaacccagaagaaatggacaagtttctagacagatacaacctatcaaggcttaaccacaaagaaatccaaaacctgaacagagcaataacaaatatcaagattgaagctgtaaaaaaaagtatcccagtgaagaaaagcctgagatccaattccctgctgaattctacagaacatttaaggaagaactaataccaatcttactcaaagtattccgaaatacaaggaggagggaatacttccaaactcattctatgagaccagtgttaccctgataccaaaatcaggccaagacatgtaagaaagaaaagaaaagaaaattacaggccaatatctctgatgaatattgatacaaaaatcctcaacaaaatactagcaacccaaattcaacagtacattaagatcattctcataaccaaaagggattcttggcaagcgtacaaggatggttcaacctacatcatacatcctatcaacagaatgaaggacaaaaactatatgatcattttacttgatgctgaaaaatcatttgctaaaattcaaacttgctgcatgataaaaatcctcaaaaaaactgggtgtagaaggaacatccttcaacataataagagctatatgcagcagacccacatctggtatcatagtgaaatgggaaaaactgaaagcatttcctctaagatctgcaacatgacaaagatgcctactgtcagcactattattcagcgtactactggaagtcccagctacagcagtcagagaagagaaagatataaagggcatccacattggaaaggaagaagtcaaattattcttgttttcagatgatatgatattatatctagaaaaaaactaaagactccaccaaacaactattagaactgagaagcaaattcagtaaagtggcaggttacaaaatcaacatacaaaaatcagtagcatttctatatgccaacagtgaacaatctgaaaaagaaaaaaaaaaaagtcccatttacaatagccacagagaaaattaaatacctaggaattaacttaaagaagtaaaagatctctataatgaaaactgtaaaactgatgaaagaaattgcagaggacaccaaaaactggaaagttattccatgttcatgggttggaaaaattaatattgttaaaatgttcatactacccaaagcaatctacagattcaatgcaatccctatcaaaacaccaatgacattcttcacagaaagagaaaaaaaatcataaaatttatcaggaaccgcaaaagacccagaataaccaaagctatcctaagcaaaaagaacaaaactggaggaatcatattacctgacttcaaagtatattatagagctatagtagctaatacagcatggtactggcataaaaacagacacatagaccaatggaacagaatagagaatctaaaaataaatttatacacctacagtgaactcatttttgacaaagatgtcaagaacatgcactcaggaaaagacagtctcttcaacaaatggtgctgggaaaactgaatatttatatgcagaagaatgaaactagacccctatctcttgccatacaaaaatcaaatcacagtagattaaaaacttaaatctaagacctcaaaactgtgaaaccattacatgaaaacattgaggaaactctcctggatattggtctgtgcaaaaatttcttgagtaatatctcataagcacaagcaaccaaagcaaaaatggacaaatgggattacaaatttaaaagcttctgcagagcaaaggaacaatcaacaaaatgaagagagaacccacagaataggagaaaatatttgcaaactacccacctgacgagggattaataaccagaatatgtaagaagctcaaacaactctataggaaaaagatctaataatccaattaaaaatgggcaaaagatctgaatagacatttctcaaaagaagatgtacaaatggcaaacaggactatgaaaagatactcagcatcattgattatcagagaactacaaatcaaaaccacaatgagatatcatttcaccccaattaaatggcttttatccgaaagacagggcataacaaatactggtgaggactagagaaaagggaacccttgtacaccattggtaggaatgttaagttagtacaaccaccatggagaacagtttggaggtttcttggaaaactaaaaatggagctaccatatgatccagcattcccactgctggttatgtacccaaaagaatggaaatcaaggccaggtgcggtggctcatgcctgtaatcccagcactttgggaggccaagacaggcagatcacctgaggtcaggagttcaagaccattctggccaacatggtaaaaccctgtttctactaaaaatataaaaattaaccgggcatggtggcacatgcttggaatcccagttactcgggaggctgagacaggagaatcactgaaacccagcgggtggagattgcagtgagccgagactgtgccactgcactcaagtctgggcaacagagcgagactctgtctcaaaaaaaaaaagtggaactcagtatttccaaggaatatctgcactcccatgtttctggcagcactgttcacaatagccaaggtgtggaatcaacctaagtgtccatcagcagatgaatggataaagaaaatgtacatctacacaatggaattctatttggccatataaagaataagaacctgttatttccaacaacatggatgaaactggaggtcattatgtttgtgaagccaggcacagaaagacaaacttcacatgttctcactcatttgtgtgagctaaaaatgaaaacaactgaacgcatggagatatatagtagaaggatgattaccagctgaggatggtagtggggaagtaaggggactaagtataaaaagtagttagaaaaaaatgagtaaaacctggtattggatagcacaacaggatgactgtagtcaataataatttaattatatatttttaaataaaaaatataattggattgactaacacaaaggataaatgcttgaggggatggatattccatataccatgatgtgattattatgcattgcatgcctttatcagagtgtctcatgtacttcccaaatttatgcagtacctactgcatacccaggaaaattaaaaatttttcaaattttttaaactaaattattcaaagaagattacaaaaagtctgatagtctctgggcaatttgtgttaatacaaaaaaaattaaaaccaggaaagaaaaccctgagagatcaggagataacatactcttcatagagatatgaagcatttctttgttttctgtgctttcttagaagcaaacctgattaggtacagaagaagcctatatatgtccttattacagtgttgagtaaaatgtcagtttccatctatcgcatttattgttcctgatttgaataccctcttctcttggatacttaatttttattctgtgaaaagaaatggaagagaggatctgagtttaggttattcataatcatctcaatataaaatagtattgcctgcttacaaaatctttcaagtttattttggaagcctaaatttttaaataatttttgttgattaattcttaagtttggcttggctcttttattacctgagacactcttaagtgtataactttgaaagcataacattgaacatcaaggtagcatcaaaggaggaaatgtataaatgtgcagtctcagtagtgtttttacgtatgtgtgtgttagtgggggtagtcatttctacccattctgaccaggtaattaagtgtggttggtgccagtagatacaaccagtttcttctaccccactcccaccagctgccctaataaagtcacttttcagttgcctgttgtccaaacctgaaaaacaatcccaatcctagggtgtatagtattattaactatagtcaccatattatgcattagatttcctgaacttttttcctccatatctacatatcaacttctgaagaacaggaatgagtaactcttttttttaacgtaggttgaaagacatacctagccaatattctaccattaacgaatacatacatattccatatataaaaatgttaacaatccataggaatatcaatattctttcatcttttcctggaatgagatacaaagtagtactgtttatataagtggaatatgaagatacgtattctcatgaaaatctcttataaaaagtgatttgttcacctgagtgcccaagttttatggttagataatttaattatcagattaatgtttagataaaagttattgaaaaataatatgtaaagagaaaagttgtgatgctaacgagtgttcactgctatgtacttgagttggttcttgaacaggggttgggatctaaatgttagcaaatacagtgagatttttcatagttaaagtgaaaaaaacttgaaaatctttcaaatacatattaatctcagtaagccaaacaaccagtttttaccccagcattgaaataaattctttggttgaattaggtaaattggttggcatgctttataaagaggaataattacctttaaacattagaaccttagctggcacagcaattcattaaccattggaactgaggtaaactgtgaaaactaccaactcagacaccatttcatgctcactgcaaagtatatgttcattgaatggaatggaaaacaaaatgcctgcagtatgtaaatttgtactcttttcttcctgtgtccttcctaccatggtactgtctcctttgacctttcatcacaaccagatcttatttaaatattgtacaatttgaactgaaaaaaaaaatggagcatcttctcttcacatgaaacgttatctgcttcttccaggaattgaagaagatgtaaatatttaagaatattaaaaccccaagaaaagatgttcattagcaataagataatatctctcaagtaaaagtgagatgccttttacaattaccttgatttccagattgcatcttctctgtgtagcagtagtctttgaccatttggttgtattattataagttgatgtggttatgattgtttgaaagttgtttgtaactaaaataaaaataaaatctgtaaatgaatggttttaattaattagactaaattcgagactgcttttacaataatgtgactcttacttccgttctgctctgtttcttgaatgagaaaaaaatagatttataacaagtactccttgaacatccttgggagtttgtcgtggatgtaacttttatccactacatgatgtcccaagaaaaatattttaaggatacctactctgtaccatagaatacttataggagcagcctcagaattgttagtttattataaccctttttaaaaatgtaaaatgaaattaatgtgtttgtcctttaataagcagaagtcaggaaaatgtaactggctggcattaaactgcctatttttacctaatttatctcctcactaaatctatattctgttctgatgaaggattctcacatttatgtcagtctacaaagttgaacataaagtgattataaagataagaccaaatggtacatattgtcattaatctacatcattccttccatcagcagtatgtttttcaaagtatggtcttctgaccagcatcagaagcgtcacctggaaacttgatagaaatgtaaattttcacctggaaacttgttagaaatgtaaattttgaggcacctagacattctgaatcagaatctctggaagtggggcccagcaatctgtattttaacaaggcttctagaagattctgatgcacactaaagtttgagaaacactgctctaactacatctcactttgataacttaacaaagttattattaatagtagtcattagctggtatttcaaagatagtctttgttatttatttaagattatttaatcagcagagggcactgcagtaattgttaaggaggaaattttattaaatctacctaatcaggttacaagcacatgagtactaatatataaatttgtctgctctgttaataaaatcatgtctataaaaataagtgaaagcactatactaagtgatttttcacagagtcactatgcatgtaaagtatttctgcacatttagatatatctattatatgttctttacgggtttttttaagacagagtctcactctgttgcccagactggagttcaatggcacgatttcggctcactgcagcctctgcaacccgggttcaagcgattctcctacctcaggctcttgagtagctggaactacaggggcatgccaccacgccgggctaatttttgtatttttagtagagacagggtttcaccatgttggccaggctggtctcaaactcctgacctcaagtgatccgcccaccttggcttcccaaggtgctggaattacaggcatgagccaccatgcccaaccatatgttctgtacatttttaaacatcattgtctgttagcaatatcttttttaaggtcatttttcctatgaagttaaaatatgaacaatttcatcaacaagatacctgaattactgaatcattgtttttgacactgtttttacagcttagcagtctttgaagcgtctttctgactttaatgttgtcctcaaagtatcaagaaaaaaaaaggaaaagatcacaattatgtgatttttcacagaagtttgcaactttcatattggaaaaatatttagacgtcaaagataaatattttatttaaaaagaatagctaagtccaattaaacctttatattttagaccgactagttcagaaatactgatacctgaagtaagactataaatttctaccatctttcaaggaataaaagaatctggtaatcaaattaataatgtataagagggaaacagaactttaagctagttaaggaaaaaatggtttcaagcttttaatggcatctttttgccattgataatgaacagtctgttaataatgaatacttgtgttatctattcattaacagatacagataacctttatttgtctgtattgtactagcatatgtgattgaaagtgataaagctacattcttcaaaccattcttctgttcagattttctaataaacaggtatctttctcttgttatatttgtaattaagttttattctcttattctttgttttctagttgcatctccccatttatagtttacaggtctttgtactcagctcttgctctcttgtccatcttccagtccccatctcattcgctgcctgctccctagtttagatccctaatttcagtattctacttcctacgtggcatttgccagtgctcttgcatctgggttcttgctctccattctctttttcctagtctttggttctctactactctttgcaggtagtttctggatttttgtattatttctgttctctaactgatatgtgcagaactgcaaggatgtaagaagaattggaaagtagaagcatagaaagagctaacatgtattgaatacctattctatgctaagtgatttatcatttagttctcagagccctcttataagatgtaggtatgttttattattacctccattatattcataagtactctggaaacttaggttaaatattttattctaattcacatagcaaaactacatagtaaagccaagtttcacatctagattggtttatttattccttcacttctttattcaacaaatatttgttgagcacatactatatgttgggctccgaactagatgctgaaatagatccagctcctattgttattgcccttaactgtgtaatgtcattttctgacttcatagatgatgatcttttactacaccaaacagcttaagaggaagagaaaataaaaggaaaatagaagggttctaatgttttatgtaaaatgtttgatacaaacgtgagaaagactgtgtttgtgcttgatttaagaataccctattgaaaagaacagtttgtatctagcatagagagtctgacatccacctaccccaaccaactcaccaccatcagcatcaatgcctttcagtggcatcaccatgatatattttttcttttatgttctaaaacatataaggtttgtgtctctatgcccaaattcttcagaagatcttcagaaagaattaactgtcctgcctgaattatgtttagagaaagatgaagaactttgtaaagaatacagtcagccctgcagaacccctaactactgtattttcgatcctcagttgattgaatccacagatgttgaaccagcaatatggagagcaactgtacctacactgtgatccatccatctatatatttttataccctgaaaaatattttagatggcttacccaaatacataaatacaacagaatttttaaaaatataaatgtgaagagtaggacagagaaaaatcagatgaaactaaagttgtgttcagtaagcctactgaaaggtattcacaaatttgttctcaaggataacttgattcacaagcattgtaatttaaaaacaaactggtaacatagaaaagtatccattcctagttatgatacttgaaaggaaatttctcctgtaggtcctcctaaagaccacagtgtaatacggtgaacaattcagatgcttcctaatgtaaataagagtttgagccattttattgattctgatttcataccacagaagcaaagcccaataaaccaattctataaaaagtgaaatgaggcattcaaagtagatcactctccagtggtctggcaaaatccagtggtatgttttagaggatttagaaaaattaatgaaccacatctcttttaggcaattctcacgtatcatttgtcaattgagtttttcatgtgctgggtgacagtgagcttacacgctctctgaggtttgttctactcactactgtaacatcaatacctcagatactacctagtacatagtagatgcttaataaatattcgttatttaaatggataaatgttgtgctttgaagtatcaattttaagtgaaatactccctttcagctatctgttgatatttcccttcatgtccctgaataaagtgtgctactatactttgggatatatcatctttatgtgaagccccgaattcatgaaatgtcaaccattgcttatataactttttcaagcaagtaatgaaataaatattaacactatccaagaagttcctttaatattgttaacagtgacatccccttgcttgatgtttagggctctgattttaacatccttgagaaggtgttaacctccataaagcaatttataacatagaagtagtgtttcgtcttggtaagtctcaaaatcataacagatagattggctttggaaaataagtaataaagattggataatgacatggatgaagctggaagccatcattctcagcaaactaacacaggaacagaaaatcaaacactgcatgttctcactcataactgggagttgaacaatgagaacacatggacacagggaggaaaacaacacacactggggcctgtcggcggggtgagggggaaggggagggagggtattgggacaaatacctaatacatgcagagcttaaaacctagatgacgggttgacaggtgcagcaaaccaccattgcacatatacctatgtaacaaacctgcacattctgcacatgtataccggagcttaaagtaaaatttaaaaaaaaatttaaatacgtaaaaaaagatgggataatgccagcaaagtccttacgtttttgttagtttttctttaaaatgtctcccattgttaaatatcctgttatgctaggattcactgtaccagtaaattgcatcaattctgctaatcctgtattctgtataattggaagggattaactaatttatatgcgttctaaactttatttataacatcaattagcatctaatacatacctgatgcattttaactgcttttgcccagagctacaatcttattgaagagtagcattctactttcaaagaaatattgaaatataaacctttctctctataccttcataatttactttttgtttgcctttctacttatttactgtaatacttcattttgcaaactttatttttgtattgcttccaactattataacttgcttaatttttggaaacagaggactggaaatggattaagtcatgtatttcaccctcaagttttagcctaaaatgtatcttgaccattatacagtaaaatatatacctattttgattgacccttcaaaaatgaaattttcttgtctttaggaaaatttaggagactttaggaaaatgaaattttcctttcattagtgtattccagatttaactgtacttatcttaagaatgccgtatcctccaggcatggtggcttatgcctgtaatcccagtactttgggaggatgaggtgggcagatcaccctgaggtcaggagttcgagaccagcttggccaacatggtgaaaccccatctctactaaaagtacaaaattagccaggcatggtggtgcgcacctgtaatcacagctactcggaaggctgaggtaggagaaacacttgaacccgggagacggagtttgcagtaagccgagatcgtgccactgcactccaggcaaaaagagcaaaactttgtcccaaaaaaaaaaaaaaaagggtgccctatcctaaaactcctagtatataggtaaaccccttcacatcattaattttttatttaaaaaagacggttgggcaagatggccaaataggaacagctccagtctgcaacgcccagcaagatcaacgcagtaggcaggtgattgctgcattttcaactaggtacacggctcatatcgttgggactggttagacagtgggtgcagcccatggagggtgagctgaagcagggtgaggcattgcctcacacaggaagcactagggatcagggaagtccctccccttgccaagggaagccatgaggaactgtgcattccggcccagatactatgcttttcccacagtctttgcaaaccgcagaccaggagattccctcgggtgcccacaccaccaggaccctgggtttgaagcacaaaactgggaggccatttgggcagacaccaagctagctgcaagagttttttttcataacccagtggcgcctggaatgccagtgagacaaactgttaactcccctggaaagggggctgaagccagggagcaaattggtctaactcagcagatcccacccacacagaacccagcaagctaagatccactggtgtgaaattctcattgccagcacagcagtctgaagtcgacctggggcactccagcttggtgtggggagggggcgtccaccattactgacgcttgagtgggcagttttcccctcacagcataaacaaagcagctggaagttcggactggacagagcccaccacagtgtggcaaagctgctgtagccagactgcctctctagattccttctctctgggcaggacatctctgaaagacaggagccccaggcaggggcttatagataaaactcccatctccctgggacagagcacctgtgggaaggggcggatgtgggcgcatacttaaacttagttccttcctgccagctcctaagagagcagcagatctcccagcacagggctcaagctctgctaagggacagactgcatcctcaagtgggtccctgacccccatgcctcctgactaggaaacacctcccagcaggggttgacagacatgtcatacaggagagctctggctggcatcaggtgaatgccgctctgggacgaagcttccagaggaaggaattggcagcaatctttgctgttctgcagcctttgctagtgatacccaggaaaacagggtctagagtggacatccagcaaactccagcagacctgcagcagagaggcctgactgttagaaggaaaactaatgaacagagaggaatagcatcaacatcaacaaaaaggatttccacacagaaaccccatccaaaggtcaccaacatcaaagagcaaaggtagataaatccacaaagatgaccaaaaaacagcacaagaaggctgaaaattccaaaaaccagaacacatcttctcttccaaaggatcacaactcctcgccagcaaggtatcaaaactggagggagaatgagtttgacaaattgacagaagtaggcttcagaaggtgggtaataaaaaactcctccgagctaaaggagcatgttctaacccaatgaaaggaagctaagaaccttgaaaaaaggttagaggaattggtaactagaataaccagtttagagaagaacataaatgacctgatgtagctgagaaacacaacacgaaaacttcatgaagcatacacaagtatcaatagccgaatcaatcaagccaaagaaagaatttcagagattgaagatcaaattaatgaaataaagcatgaagacaagattaaagaaaaaagaatgaaaaggaatgaacagagcctccaagaaatatgggactgtgtgaaaagaccaaacctacttctgattgctgtacttgaaagtgacagggagaacagaaccaagttggaaaacactcttcagggtattatccaagagaacttccccaacgtagcaagacaggccagcattcaaattcaggaaatacaaagaacaccacaaagatactctttgaggagagcaaccccaagacacataatcatcagattcaccaacgttggaatgaaggaataaatggtaagggcagccagagagaaaggtcaggttacccacaaggaagcccatcaagctaatggcagatctctcggcagaaacccaacaagccagaagagagtgggtggccaatattcaacattcttaaagaaaagaattttcaactcagaatttcatatctggccaaactaagcttcataaacaaaggagaagtaaaatcctttacagacaagcaaatgctgagacaatttgtcatcaccaggcctgccttacaagagctcctgaaggaagcactgaatattggaaggaacaactggtaccagctactgcaaaaacatagctaattgtaaagaccatcgacactgtgaagaaactgcatcaactaaggggcaaaataaccagctagcatcatgatgacaggatcaaattcacacataacaatgttaaccttaaatgtaaatgggctaaatgcccccaattaaaagacagactggcaaattggataaagaatcaagacccattgatgtgctgtattcaggagactgatctcacgtgcaaagacacacataggctcaaaataaagggatggaggaatatttagcaagcaaatggaaagcaaaaaaaagcaggggttgcaatcctagtctctgataaaacagactttaaaccaacaaagatcaaaaaagacaaagaagggcattacataatggtaaagggatcaacgcaacaagaagagctaacctaaatatatatgcacccaatacaggagcacccagattcataaatcaagttcttagagacctgcaaagagacttagactcccacacaataatagtgggagactttaacaccccactgtcaatgttagacagatcaacgagacagaaaattaacaaggatatttaggacttacactcagctctggaccaagcagacctaatagacatctacagaactctccaccccaaatcaacagaatgtacattcttctgagcaccacatcacacgtattctaaaattgagaacataattggaagtaaaacattcctcagcaaatgcaaaagaactgaaatcataacagtctctcagaccacagtgcaatcaaattagaactcaggattaagaaaatcacccaaaaccgcacaattatatggaaactgaaaaacctgctcctgaataactactgggtaaataacaaaattaaggcagaaataaataagttctttgaaaccaatgagaacaaagacacaataaaccagaatctctgggacacagctaaagcactctttacagggaaattcatagcactaaatgcccacaggggaaaatgggaaagatctaaaatcaacaccctaatatcacaattaaaagaactagagaagcaagagcaaacaaattcaaaagctagcagaagacgagaaataactaaaatcagagtaaaactgaaggagatagagacacaaaaaaccttcaaaaaatcagtgaatccaagagctggttttttgaaaagattaacaaaagagatagaacactagccagactaatgaagaaaagagtgaagaattaaatagatacaatacaaaatgataaatgggatatcacactgatcccaccaaaatacaaactaccatcagtgaatactataaatacctctatgcaaataaactagaaaatctagaagaaattgttaaattcctggacacatacacccccccaagactaaaccaggaagaagtcaaatccctgactagaccaataacaagttctgaagttgaggcagtaattaatagcataccaaccaaaaaaagcccagaaccagacagattcacagctgaattctaccagaagtacaaacaggagctggtaccatttgttctgaaactattccaaacaacagaaaaagagggaatcctccttaacttactctacgaggccagcatcatcctgataccgaaacctgagagagacacaacaaaaaaaatttcaggccaatatccccgaggaacatggatgcataaatcctcaataaaatactaaaccaaatccagcagcacatcaaaaagcttatacaccacaatcaagtcagcttcatccctgggatgcaaggctggttcacatatgcaaatcagtaaacataatcctcacataaactgaaccaatgacaaaaaacacatcattatctcaacagatacagaaaagtcctccgataaaattcagcggcacttcatgctaaaaactctcaataaactaggtattgatggaacgtatctcaaaataataagagctatttatgacaagcccacagccaatatcatactgattgggcaaaagctggaagcattctctttgaaaactggcactagacaaggatgccctctctcaccattcctattcaacatagtattggaagttctggccagagcaatcaggcaagagaaagaaataaagggtattcaaataagaagagaggaagtcaaattgtctgtttgcagatgacatgattgtatattttgaaaaccccattgtctcagcccaaaatctccttaagctggtaagaaacttcagcaaagtctcaggatacaaaatcaatgcacaaaaatcacaagaattcttatacaacaataatagaccaacagagagccaaatcatgagtgaactcccattcacaattgctacaaagagaataaaatgcctagaatatgactaacaagggatgtgaaggacctcttcaaggagaactacaaaccactgctcaaggaaataagagaggacacaaatggaaaaacattccatgctcatggataggaagaatcaatattgtgaaaatggccatactgcccaaaggaatttatagattcaatgctatccccatcaagctaccactgactttcttcacagaatcagaaaaaaactactttaatatggaaccaaaaagagcccttgtagccaagacaatcctaagcaaaaagaacaaagctggaggcatcacactacctgacttcaaactatactacaaggctgcagtaaccaaaacagcatggtactagtaccaaaacagatatatagaccaatggaacagaacagaggcctcagaaataacaccacacatctacaaccattttttctttgataaacctgataaaaacaagcaatggggaaagaattttctatttaataaatggtattgggaaaactggctagccatatgcagaaaactgaaactggatcccttccttacaccttatacaaaaattaactcaagatgaattaaagacttacatgtaagacctaaaactataaaaaccctagaagaaaacaggcaataccattcaaacatgggcaaagacttcatgactaaaacacaaaaagcaattgcaacaaaagccaaaattgacaaacgggatctaattaaactaaagagcttctgcacagcaaaagaaatgattatcagagtgaacagacaacctacagaatgggagaaaatttttgcaatgtctctgtctgacaaagggctaatatacagaatctataaagaacttaaacaaatttacaagaaaaaaacaacgccatcaaaaagtgggcaaaggatatgaacagacacttctcaaaacgaagacagttatgcagccaacaaacatatgtaaaaaagctaagggtcactggtcattagaaaaatgcaagtcaaaaaccacaatgagataccatctcatgccaattagaatggtgatcattaaaatgtcaggaaaccatagatgctggatagggatgtggaaaaataggaatgcttttatactgttggtgggagtgtaaattaattcaaccattgtggaagacagtgtggcgattcctcaaggatctagacccagaaataccatttgacccattactgggtatatacccaaaatattatatatcgtcctattctaaagacacatgcacacatatgtttattgcagcaatattcacaatagcgaagacttggaaccaacccaaatgtccatcagttatagactagataaagaaaatttggcacatatacaccatggaatgctatgcagccataaaaaaggatgagtttatgtcctttgcagggacatggatgaagctggaaaccatgattctcagcaaactaacacaggaacagaaaaccaaacactacatgttctcactcataagtgggatttgaacaatgagaacacatggacacacagagggaaacatcacacaccagggcctgtcaggggatggagggttaggggagagatggcattaggagaaatacctaatatagacgggttgatgggtgcagcaaaccaccatgccatgtgtacgcctatgtaacaaacctgcacgttctgcacatgtaccccagaactgaaagtatattaaaaaaaaaaaaagtggagaaatctgaaaaaaaaaagacagttaatttacactaaagattaggaagatggtaaatgtagaatttttcctctagccagtacatggggaaacctgacatgatgacttcttgagatccttttaattctattataaaagcatagagctaggagagatatggattatctcaggttttcagagactaattatttcaagagtaatagacaaaggaaaatacccagattacttacctggtgagaaatctactaagttgttatagcaatctgaggccacatttttagaatttaagttattagtgagatgagatttctatcaaatacttctgagctataagcaatatgaaaggactgctaatataaaaattttctttattttcttggtcctcagcttttattcagtggtccttgtgaattgagtctggatgcctcaaaaagataaatgtttcagaaactaaaagtatggttattgaaagcctggtttataatcatttttaagtgggttttactagtctgacttcattcttttttggcttatttcactcagtctgctatttaatctttaattacaggccacaaaagaagtaatagaacgggaagcaccagggatggccctggcaatgctgatgggatcacttaatgttacacctctgggcatgctctctaggtaagaaagtcaccaacatgttgcaaaccatttgctaggtgaactgtttccgtgatattaaaaaaaatctacactttggcattgttgtgaatattaaatgagctagtccacataaagttcttagcttatactaatcacttaataaatattacctactatcattgttaaaaaaaaaagttaattccataccactaatcaatacactatattgatgaacctaagaaactttagtcttaacacttaagtttgccccttttttttccagagttaagagctttagtattctgtcagccacaattttcccacttcacttctttttgttgttgttgttgttgttgttgttgttgcttgttaagttaaactttcagagactgtcatattactactggtaaaagttatcaattcctaacccagagaatccagtttattactatgtaaagttactgttttctgtgactgtttataatcatcagttgatatctattaattgtaggtaaatactgatttaataaaactaaactgccaagtttattaaaataacttgttctcacaagttaggagcttatattccaatttataaatagctatgttgatgtgttgttgtgaaaaaaaagaagctcaattcatattgttaatcttttaatgcttggcaactgggtatattttaattattatattacattaatgatatactattattatatgaaattagtctacctaaaactatgcctttgttgacatagatgttgatatccatcctcgatttaatggtacttatttgctactattttagcaactcttagatttagatcccctaaatgaggacaattacatcacttaagttaaagatagaagtgtcaacttagtcagaaactgttgaaggatttaatgaacgttaattaatagttgatctcagagcaacctaaaaataaatagcagctgtatagtttcagggtttcataatttatagccctttatgtatcctgtgtgtaatatgaatataaaattaaatgtgtccattgactattatggaatatgagttgtaatgttctttctgttacatagacaaagtttatatcccatcagtggcagccacttgaagcacagatacaggagattatgaatgggtcattagttactatgttctttttgctgtcacgtgtactgtaacatttaattttagtaaaagcaaataaagaattaaagtaccacgatagagactaaagctaaaattcatgctggcctttaaggaactccagttgattctttcatagtgttctttttttaaaccattacttatattacctacaccaatgaggtcaggggatcccgtttttcctatggaattaagtagtagttttcaaacataaaagaactctttcttgtatacaagcaataacatcaggaaagaattaaacttcattctcttgctaattcttttgtaataaaattttaattcggtaaacataataatatgcttatttgccaagtcccatattaagcattagggatcctaaggttagaaagaaaaataagaaatggtcctctccttaaggatcccacagtttaaatggagaaattatttcttgcaactgttaagataattcttcaaattgaatgtagctttcttgatccagtatagaaatatcactttttgttatatcaaaaggttttcctgaattaatttttttctcccttttgtatcctcataattacctagcactggactgctgagtgaatggaaaattaattagcaggagctgattctaattactttggaatgagttgttcatctttatcctgaaggctttgaaaattaatacatataagcagcatgggagcaccttctggcttttctgtctgtgcattgctgatttaaccaagaatatatttataaactttggaacagacatagtagtttacattagttacagaaaaggggatatttccctgaatgttcattttttgtgcttctcaaagcctttttaaaaattattatttttataatagccatcattagattggttcttcctttctacagcctttctattttgtatgcacttctggctttgtacatgcttctgctatggaacatgtcatagtatattgtaattaattatttgcttgtctgtattacctagttagtagaaacttcttaaagacaggagctttatcttattcttttttacatcctcagcccctaaaacaaattctgacacatagtaagtactcaaaaaatgtatattgttgcagttactatggataaatcagtgttttaccatagttctatagcatgtttttttcaggtaaattaatgcatcaagttggtgccttaccttcctatttttatgtctagagagcagcattagataaaaacaaatgtttaaaccattacgtctgtttgaaatggtttcctactatttggacaacttaatatcctccagattttttatataagtaagttgggagatattatgaagtaatggttaagaacatcatctctgaagacagattgcttgtgttctatgttaatgtcttttttgttttcattttctcatctatataataaagatgttaatagtaccaaatttcttggataaagtgaattaatctatgtaaagcacttagaaaactgactcgtagtaactcttaagtgatgaccatggttgtttcgttagagtttttgtttttagagtaggtctgctggtgaaaccttttcgtagcttttcttcattaggaaatgtctttatttccatattactcctgaaggatattttcactagatacagaaatctgggttgactgttcttttctttcagcattaaaaaaaaaaaagtaaaataaaatatgattccactctcttttgctccatggttcctgaaaagaaatgagcaatcaattcaaattgctgtttccttatgtgtaatggcaaatttctctggctgctttgaagatattttttctgcagctttagtttcagcaatttgattatgatgtatctgggtgtagttttcttttagattatccttctgggttcagtgaactttatgattctgtaaatttatgtctttaaccaaatttgggaaatttccttttttttgctgctcctatgacatgaattttagattttttggtaatgtctcacaaatccctgaggctctgttaatttttaaaatcttttttactctgtattaattttaggttatttctatgatctatcttcaaattagctgacttttcccctctttcatcttcattctgcctttgagaatatctagtggtttttatttcagatatattttcagttctaaattctccatttggtttttttgttaatggtttccatttctctactaagaacttgtatttttacatttatttcaaaagtattgccctttatgtcatggagaatagttataataactgcttaaaattattcttcggacaatttcaatatctggcttaccttggggttgacatcggttgatttcttttcccatgagaactggtcaaattttccttgttctatgttgagaaattttggattgtatcctggacattttgaacactgcattgtaagtaaattatttaactcctgttaaaatcctttggggaattttaattagttagttttagcaattgatctgattgggttcagattgtaaattctgtctcactttctgtgggtagtggctcagcctttgctatattgttagtgtctgcccagtacatgaatgatttaggagttagtttgagacttgggcagtagtatatactaggtttatgttttaaaatcttttcttgtacttattttatactgtcccacgtattcacagctcagggatgaccctggaacttgggtcaattcacatccaaaattagagaatccaccttctttagctctcttcttttcaagaattttcccctcactctccagcttccaggggaccccattcccagttactctggccagaagaggtttcttacagagtattaactccctttgcaattatgtagttgtacacaactgacctttgggacaaagagcaaaagaaaagaaaaaagagagaaagagattcctcttaccttagttctttagacaatatcggctccttttttttgtttccattagccaaagagataggtaggtcttctctctgagctttgggtgctaacactgtcattatggtattgcagctccacaattaggcctagccccattaagagctgttattcaagttctgacttcagtcccaaatctgcctgctattatttacattaaacgtcatcaggtaatcactgtgtactctataaacaatcggtaggagagagaagctatggttactttctccatcttggctgacaccaaagaacaagtgttcaaactttaataccagatccctgacttcatatttactagcatttactagcagtgttaccttggtactttacaaggtttagcacatcttgttccagtggttaactaaactgcccacaaaatagtagcatttaacctccctaaatttataatttattccctacttgtttttttttaaaagatcaaatactcttttttccccctaaatttcattaaaaacaacagactaaccactgtggttatacactgaagaatgatttgtcatggattttattctcagttttgtcattaatttgatttatgatctctacttagttttatagggatattacatagctgatagaaatgttatgaggtcctttaaagatttactcacacatatgtgtgtgtgtgtgtatgtgtgtgtgtatatatatatatatatataaaataagaaatatctaattcataaaaagagaaattgattgccagttttccattttagtatgaagagatttaccattgtaatcttcagtgactcatctttcaattctgtaactgtaataaacacatgcactgcttttagggaggagataatattttccatttgctgccaaaaatggttttataactgatattggttaaaagaaaaatttcaggaaataacaacacaaaacttattttttatagaaatgaatcaaattattcttagtattatttagataatattaaagtaacatgagtcatttaaagtaacagtactatcatcttaaagagtttctgtttttttaacccacaccaaatatacttagcttataaaagtctgtaggggagcataagatggcagagtagtatatataggaatctgtttctccacctggacaaccgtttgaactggcaggatctctctgatataactattttggaactttgtagtctattcaaaggcttatggcttactggaaaagacttgactagtagattttggttaatttgggtcaattttaacctagtgtgctactagccaaccattctccagtgctccagctagcaggtactagggtttataggacagcttgtagaagacagaatgggtaattaaggaccttatcttccaaatattggggatccaggttctattgtggattactgctttaggttgtagaagtgcagaggcaaagacaggctgccattgtttcaacccacactggctgaagtatcttcaagggatttataaggacagtacctacattttcccctacatttttcttcttctcttttgggacccagaaattacaggattagaaaattcaaaggcagctacatatatgggggaatttagaaagtcactatgcatgcccagaggaaaaggcaggctgagaaaaagagaaaggccttaagtttatacctcaggcttatttcttacacagaacactttataacaatttaaaaaaaaaaaaaagcaaaccctagggaagggagagaagctgatttctagaattaccatattataagattcaaatattcagagttcaacaaaaataaaatgacaaagcaaagaaaaagtatgatccattcaaatgaaaacaataaattgacaaaaatccatgaggaagatgaaatggagaacttactagacaaaggctttaaaacaactatcttaaagattctcaaagaactaaaggaatatattgataatgccaagataatgatgtgtaagcaaaagtaaatatcaataaatatattttaaaaacataaaaaaagaatcaatcaggcagctaaaatgacctatcagtttaatatcatcttttaaggccatgatgggactgtccataatcaggcttctctccactgtatgcaggaggaagtggccactattaacagccctccctttttgtagcattagacagcaacaggccaccctgagattatttacagagaacagctataaaaacacttgcaaatatattcagtccagactagaaaatacttttcccccatgagtgtgaagattcatattgtaggctagtaaatctctctgcacatgttcatcatgacaatgtactcaggagttctaagtcatgatgagcatcctgcagcagttccagtgaattatggatgaaaaacatgtatcctttaaaaaaataaagaagaaaaaaaaaagaataatgaagaaatgagttgacaagtacaatcgctgaaaaaaaatcattagtgggattcaaaagcagttttcagcaggcagaaaaaagaatcagcaaacttaaaggcaaaacaattgaaattaacaaatctgaggaacagaaacaaaaaagatggaagaaaactgaacagagcctaagggacctatggaacaacattaagcagaccagcatacacattatggggattcaagatggatgagtgagggagaaaggggcttaccagagcaaaaactcatgaacactaataagcgtgggaaactgtcaggtaggcaaacctaaactgtaattgacaaattgctagaggttcagtgcagacaactatgagagttaaaaacttcagggaaactcagtcgctacaattttgtgaaaactgaatggaacctaagggatctctggaacaagtcttcggaacaaccaggttctcacagtaaatattagaggaaaattccctcatgtttcagcagggaagaggaaagggaactattgtgaaatacaccagggtactctgttcttcttaatgagccctaacccgaggagaaactacttaacctgaacctaccctgctggagtataatcaaatactaacttacctaggggaagggaaatacccaacttcagctcactgtagccatcttctcccatgtaacaggggaggaaaaattgagaaaaactcgtgaagttcactaaaagcctcactaaaagactgagacctggccaggcatggtggctcacacctataatcccagtgctttgggaggccaaggcaggtggatcatgaagtcaggagattgagaccatcctggctaacacagtgaaacctcatctactgaaaatacaaaaaattagctgggcatggtgccacgtgcctatagtcccagctgaggcaggagaatcgcttgaacctaggaggtggaggttgcagtgagctgagatcgtgccactgcactccagcctggcgacagagcgagactccatctcaaaaaataaaaagaccaagacctaatgataggactatagaatacttccccacccccacacatccccaccacattactagaggcctgtctacagcagttccttttacctggtatatcatgtttggctatgaagaaaaattacaaggcatatcaaatggcaaaaaaatacaatttgaagagacaaagcaagcatcagaagtagacatggcaggaatgttggaattatcagtctgggaatttaaaaatcattgtgattaacatgctaagtgctccaatggatgaaacagataccatgcaagaacagatggataatgtaatcaaagacatgaaactcctaagaaccaaaaataaatgctagagatcaaaaacactataacagacataaacagtgcctttgatgggcttattagtagaatggacacagctgaggaaataaaaaactcttgagcatgaggatctctcactgcatacctccaaaactgaaaagcaaagagaacaagttctgagaaacgaaaaaacagaacagaatatcaaagaattttgagacaactctaaaacgtagaacatctacataatgcgaatacccaaaagagaagaacgagaaaaacagaagaaatatttgaaacaatgaccgagaatttccccaaattaatgtcagatgtcacaaaaacaactatacctagacataccatcttcaaactagagaaaatcgaaaataaaaaatcatgacagagtccagaggggaaaaaaactccctatctatagaggaagaaagataagaattacatttaacttgtcctcagacatgcatttaaaaaatcagtctatgatttggggcatacagtatgtaaagatgtaatttaagacatcaataactaaaaggggtgagggacagagtagtataagagcagaggttttgtatgctgttgaagataagctggtataaattcaaattattactttaggatgttaaatgtaatcttcatagtggccacaaggaaaataggtacaggatgtacattaaaaaaatgagaaaagaattaaaatatttcactaaaaaaaattaagaacaaatgaagatagtaatgtaggaaataaggagttaaaaagctataaggcatatggaaaacccttaacaaaatggtagaattccctttttgtcactaattactttaagtgtaaatggattaaactttccaatcaagagacagagattaatggactggataggaaagcatgatccagctatatgctgtctacatgagactcattttagatccaaagacataaataagttgaaagtgaaaggatagaaaaagatagtcaggcaaatagtaaccaaaagcgaaccatggtggctataataatatcaaataaattttaaatcaaaaatgtttaaatatcttaaatccaaaaagtttacaagagacaaaggatatatgttactagaaggtttaattctgcacagtaatattatacttataaacatttatgcacttaataatagactgtcaaaatagatgaagcaaaaatggacagaattgaagaggaaaatagacagctatgcaagaatagttgaggaattcaatatgccacattcaataatggatagaacagccacacaaaaggtaagtaaagaaatgtaagaacttaaacaacacaataaaccaactagatacaacccacatatataaaacacttcacccaacaacagtagcatacaccttctgaagtacacatgggacattctccaagatagagcacattaggctacaaaataagtttcaataggttttttaaaatagatgccataaaaagtatattgcaaaatagtatattcttcaaagcatattctccaaaaagaggatgaagttcgaaatcagtgacagaaggaaaaccggaaaatttacaaatatgtgaaaattaaacacactcaaatagccaataagttaaagaagaaatcataagggaaattagaaaatatttaaaagtgaattaaaacaaaaatgcaacataccaaaacttcatagcatgcagaaaaagcagcactgatattgctgtaagcatttaaaaaataattacatttttgaaaacctcaaaaacagcagtctcatgtataactataagttaagaaactagaaaaagaataacaacctaaacccaaagctagcagaaagaaggaaataataaaaattagagcagagataaatgaactagaaaatcaaaaaacaatagagaaaatcaactaagctaaagttggttcttcaaaaagatcaacaaaatcacaaaattttagctagatagactaagaaaaaaaaagaaactcaaattactaaaatcagtaatgaaaatggagtcattagtaccaattccacagaaataaaaaggactagaagagtacagcgtaacaattacatgccaacaagttgaataacccagacgaagtggacaaactcctagaaacacaaaacctactgagactgaatcacaaagaaatagaaaatctgaatagacctatacctaggaaggagaatgactcagaaattaacaacctctcagctgggtacggtggctcacacctgtaatcccaacactttgggaggccaaggtggatggatcacttgagcacagcaaaaccagcctgggcaacatggcaaaaccctatctctactaaaaattcaaaaaattagccaggtgtagtggcacacacctgtagtcccagctactcaggggtctgaggcaggaggatcacttgagcccaggaggtagaggccacacagtgagccctgatcatgcgcactgcgctccagcctgggcaacagagtgagaccctgtctcaaaaaaaaaaaaaaaaaaaaacctttctatctttctatttacaaaataccaggaccagttggcttcactgatgaattctaccaagtatttcaagaacaactgacactggttgtttccaaaatcttttccaaaaaattgaagagaagacaacacttcctaactcattttatgaatggcagcattggtctcataccaaagacaggaaaaacaaaacaaaactgcaggccaatatcccttaatgaatgttgatggaaaaatgctcaaaaaaaacccccagcaaactgattgcagcaacatattaaaaagaattatacaaggtgaccctagaatacaaggatggttcaacatatgaaaataaatcattgtaatataccacagtagcagaatggagggaaaaaaaaacccatgtgatcatttgatgatgggttttcagcatcaatgggtgctgaaaaaaaatttggaaaaattcaagtttcatgttaaaaacactcaacaaactaggaaaagaaggaaactaccttaatgtgaaaaaggccttatgtaaaaaacccacagctcacatcatattcagcggtgaaagactgaaagcttttcctttaaaatcaggaacaagatggggatgcccactttttccacttccattcaacatagtattggaacttctagccagaacacttaggcaataaacagaaatgaaaggtatccaaattggaaaggaagaagtaaacctatctttttttttttgacatgattatatatgtagaaaacccaagattccacacacaaaaccattagaactaataaatgaattcagcaaagttgcagaatacaaaatcaggctgcaaaaatcagtcttatttttatacaatgacaataaactatccaaaataaaatcaagaaaatggaatagaaacaagagcccagaaataagcccttgcatataggatgtaataattttcaacaagggtgtcaattcaatgggggagagaatagtcttttcaacgaatggtgttgggaaaattggatatccacttgccaaagaatgaagttggacctttgcctactgaatataaaaattaattcaaaatggatcaaagacctgtacacaagagctgaaactaaaaaactcttagaaaaaaacatagggggacagcttcatgacattagatttggcagtcatttcttggatatgacaccaaaagcataggcagcaaacaaaaaactagataatttggactttatcgatgttgaaaatctttgtacattgaacaaagtaaaagggcaacccatggaatcaagaaaatattcacaatcacatatctggcaaggtattaatattctatatatatatattttttttaattcctacaagtcaataaagaaaatgctatttaaaaacaggcagaagactcaaatagatatttctccaaagaagatacacaaatgactgataacatgaaaagatcctcagcatcaatagtcattagggaaatgcaaatcagaaccacagtgatatacaacttcacacccattacgttggctgttatcaaaaaaataataataaataagtggtggcagaatgtttagaaacattgtgtattgctggtgaggatgtaaaactgtgcaactgctatgggaaactatggcatatcctcaagaaattaagcatagaattatatgacccaggaactccacttccaagttacatatccaaaagaattgaaagcaggggctgggtgtggtggtttaaacctgtaatcccaacactttgggaggctgagacaacaggatcacttgaggccaagagtttgagaccagcctgagcaaaatagaccctgtctctacaaaacttgtttaaaaaaattagccagtcctggtgacacacacctataatcctagctactcaggaggatgagggaggagtatcacttgagccccggaattcgaggttacagtgagctgtgatcatgccactgcattccagtctgggcaacagagtgagactgtctcttaaagaattgaaagcagggactgtaatagatatttgcacgccaatattcataacatcattattcaccttacccaaaagttggaagcaacccagatgtccattgattgatgaatgcataaacaaaatgggttaaatacatggaatgaaatattattcagccttaaaaattattgttaattctaacacttgctacaacataaatgaatcttgaaaacattgtgctaaatgaaataagccagattatataaggacaaatgtgtgattccacttacatgaagtatctagaataaccaaatgcataaagaaaatagaacagtgcttatgagtggatagcgagaagagaatggagagtttttgtttgggatgatgaaaaagttctggagatggacagtggtgatggttgcacaataatgtgaatgtacttaatgccactgaattgtatacttaaaattagttagaatggtaaaggttatgttatgtatattttaccagagttccttttatagctataggacaggaaatgcaacatacataaaatgtacattttcttgaaacatttctgcagtgtttcaggcccaacttccagactccagtatgacaggaggtatactgggtttcaaaagacaagtgacacagatggtgtgaggaccacctcaacacaggagagctgacacctttctccttctctcacccaacttttatattttcctaaatatcatagcttcataacagatttgtgatagctggacttatttgttataactcataaaataggaactctgggcaataggaacagctccagtctacagctcccagcgtgagtaacgcagaagacaggtgatttctgcatttccaactgaggtaccgggttcatctcactggggctcatcggacagtgggggcaggacagtggttgcagcccactgagtgtgagctgaagcagggtgaggcattgctatttatgacaaacccacagccagtatcatactgaatgggcaaaaactggaagcattccctttgaaaactggcacaagacagggatgccctctctcaccactgctattcaacatagtgttggaaattctggccagggcaatcaggcaagagaaagaaataaagggtattcaattaggaaaagaggaagtcaaattgtccctgtttgcacatgacatgattgtatgtttagaaaaccccatcgtctcagcctaaaatctccttaagctaataagcaacttcagcaaagtcttaggatacaaaatcaatgtgcaaaaatcacaagcattcttatacaccaataacagacaaacagagagccaaatcatgagtgaactcccattcacaaatgcttcaaagagaataaaatacctaggaatccaacttacaagggatgtggaggacctcttcaaggagaactacaaattactgctcaacaaaataaaagaggatacaaacaaatggaagaacattccatgctcatggataggaagaatcaatatcgtgaaaatggccatactgcccaaggtaatttatagatttaatgccatccccatcaagctaccaatgactttcttcacagaattggaaaaaactactttaaggttcatatggaaccaaaaaacagcccacattgccaagacaatcctcagccaaatcctaagctggaggcctcacactaccagacttcaaactatactacaaggctacagtaaccaaaacagcatggtactggtaccaaaacagagatatagaccactggaacagaacacagccctcagaaataataccacacatctaccactatctgatcctgggcaaacctgacaaaaacaagcaatggggaaaggattccctatttaataaatggtgctgggaaaactggctagccatatgtagtaagctgaaactggatcccttccttacacattatacaaaaattaattcaagatggattaaagacttaaatgtaagacctaaaaccataaaaaccctagaagaaaacctaggcaataccattcaggacataggcatgggcaaagacttcatgtctaaaacaccaaaagcaatggcaacataagcaaaattgacaaatgggatctaattaaactaaagagcttctgcaaagcaaaagaaactaccatcagagtgaataggcagcctacagaatgggagaaaatttttgcaatctactcatctgacaaagggctaatatccagaatctacaaagcactcaaacaaatttgcaagaaaaaaacaaccccatcaacaagtgggcgaaggatatgaacagacacttctcaaaagaagacatttatgcagccaacagacacatgaaaaaatgctcgtcatcactggccatcagagaaatgcaaatcaaaaccacaatgagataccatctcacaccagttagaatggcgatcattaaaaagtcaggaaacaacaggtgctgaagaggacatggagaaataggaacacttttacactgttggtgggactgtaaactagttcaaccactgtggaagacagtgtgtcgattcctcaaggatctagaactagaaataccatttgacccagccatcccattactgggtatatacccaaaggattataaatcatgctgctataaaggcacatgcacacatatgtttattgcggcactattcacaatagcaaagacttggaaccaacccaaatgtccatcagtgatagactggattaagaaaatgtggcacatatacaccatggaataccatgcagccataagaaaggatgagttcatgtcctttgtagggacgtggatgaagctggaaaccaacattctcatcagactatcgcaaaaacaaaaaaccagacaccgcatgttctcactcataggtgggaattgaacagtgagaacacttggacacaggaaagggaacgtcacacaccggggcctgttgtgggatgcggggagcggggagggaaagcattaggagatatacctaatgtaaatgacgagttaatgggtgcagcaaaccaacatggcacatgtatacatatgtaacaaacctgcacattgtgcacatgtaccctagagcttaaagtataattttaaaaaatatgtttattttaaataaaaaatggaaataatatttttgaagtaaaatgatttattgatgaaaaatacttgaaacagaagatactagaataatactttcaatgtgctgaaagaaaataacatttaatcaagaattttacactcagcaaagttaccattcaagaatgggggaggatgaaatgtcattttcctacaaacagaaatgggaacattttatcaccaaaagaacctcacgtaaagaattttaaagatatactctggcagaagaaaaatcatctcagatggagagttgaggatacaggagggaaaagagagcaaagatattggtaaatatctgaacaaatcttttttaaaaaattgactattgtcctggtccattctgctgctgtaacaaaataccttagactgggtaatttataaacaacagaaatttattgcttacagttctgggggctgggaagtccacaatcaaggtgcccgcagattcagcgtctggtgaatgcttcaaagatggccctttcttgctgcatcttcacgtggtagaaggggcaaactagctcctgacggcttcttttataagggcactaataccactcatgaggacagagttaatcacctcccaaagtcctcaacactttatactattgcactggggattagatatcagcatatgaatttggggtaaacaaaaacatttagacaatggtaactatataaaacgataaaaataatgtctcaattatgggaagaaaaaatatgttagaattcttgaaaacagcatgtaatttgagatactgtgattatagttaagtattctaacaggccaggcacagtggctcacccctgtaatcccagcactttgggaggctgaggtgggctgatcacttgagtccagaagttcgagacaagcctgggcaatatggcaaaactctctttacaaaaagatacaaaaattagaccagcatgatagcacgtgcctgtagctactcgggaaactgaagtgaaagaatcacctgagcctaggaggtcaaggctgcagtgagccatggttgtgccactgcactcgcctggggtacagagtgagaccctctcttaaaaaaaatttagtcctattttctaggaagatattaaatattgattatagttttttaaagttaagtatgcatattaaacttattagggtaatcactaaaaggatggacggagtatacaacttccagaaatagagggaagaaattaatgaggaaaatacttaaagtaagataagaaagggagaaaaaaacaaacaaacaaaacaaaacaaaaaaaaacaaagacaagtagaaggcatatgtattggttaaaaaaagttataatacgaattcccagaacatcttccacttaaaattttcccatagaacactgcttagtttctcatattcaaacttgataaacatgtataccttcatgtttatctgaaaaacagcttcagctgatacatatgaaaattttatatttatatctgaaaaattcagtaaattttcaaaaaaattttattaaacttttaagatggtaatataattgtagattggcatgcagtataaggaatgatccagagaagtcctgtgtaccctttactagttttttccagtggtaacatcttacaaaactatagtacaaaattacagttggatgttgacattgataacatcatgacacaacaatttgttcattctttcatttgttcatgggtacttaggttgacttcatattttgcctgttgtgaatagtgctgcactaaatgtgggagtgcagatgtgtttttgatatactgatttcctttcttttagatatatacccagtagtgcaattgctggatcatatgataattctatttctagttttatgaggaaatttcatactgctctccatagtggctgtactattgcttttctattgtcattgcccttttattgccacaccacctctctgtcacccagcccccctttcctaaactctggcaaccactaatctattttctagttcaatattttgccatttcaagaatgaatataattagaaccatacagtatgtagccttttgggattggtttcttccattaagcataatttcctggagattcgactaaattgttacatggatcaataattccttacattttattgttgagtagtattccatactatatatgcactacagtttgttcaaccattttctgttgaaggacatctgggttgtttacagtttgtaattatgatgaacattacaccaaacgatgcggtatctaggttccatggcagttgcaggttttctgtttaaatgaactgtcaaattattatccagagcaactgtatcattttacaatcacaccaacaatatatgagtgtgtctccacaccttgccagtatttggagttgtcactatttttattttagccattttgatagttttgtaaatagttttaatttgcatttccctaatgactagtaattttgagcatctgttcaggtgttttgcctattgtctgactgtgttttttagtttttttatccctgatttttgagagtttttatgtgttctagaaacctgtccttcgtcagatatgtggattgcaattgttttctcccagtcaatacattgtcttttttcctcttcacagtgtcattcacagagcaaaactacttaatttccatgaggtccaatttatcatctttttcttttagcagttgtgtttttttgatgtaaagtctaagcacccttcacctaggcaaaggtccaaagactttctcctgtgtttttttctaaaacttttataattttacattttacctttaaatccatttgagttgatttttttctaaggtgtgagtttaggttgaggtgttttttcgtttggttggttggttggtttttgtgtatgaacgaccacttgctccagtgctacttgtttaaaaaaaaaaaaaaaaaaaaaaaaagctacctttcctctgttgaatggcttttgcacctttgttgaaaattaatctggcctattattagtttagttctagttctggtttctctgttctgttctatatgtctgtccctctgtcagtaccacataatctttatcattgtagctaaacaataagtcttgaaattgcatagacagattcctcccactttagttgtctttttcaaaatttttagctattttggtcccttttgttttccatgtaaattttagaataagtttgtctatatctacaaaaaaattgctcagatttttataggaattacattaaatctggatgtaaatttgggtggaagtgacatcttttccatgttgagcctccatgaacacattatgtctcttcctttagattgtctttgatttcttttattgcagttttcagtataaaaagtctgaacatgtttcgttagatttacacttaagtatttaattgtgttttcagttattgtaaatggtgttttattattaatttaggtgtccacctcatgttcattgctaatatatatagaaatacaattaattcttggatgttgattttatattctacagccttgcttaattgctagtactattaattctaggagggctttttcttttttttttttttgttttttgttttgtttgttgtttgttttgttttattctttgggattttctgtatagacaatcacatcatctgcaaataggggtagttttacttcattctttgtgatttatatgccttttattctttttctgcctgttgtcctagctaaaacttccagtgctattttgaatagccatggtgaaaatggatatccttgctcttttcctgatcttggggagaaagcactcaatgtttcactattaagtatgttagttgtacatttcttataaaagctctttttcaaattaaagaagtccatcccttaatttctacattttttgagagtttttatcatggatcagtgtttgattttgtccggtgaatttcctgtgttaattgatatgattgcatgatctactttttcttcttagattgttgatatgatgcatatgttgatttattttcaaatattgagctggtcttgaattcttggagtaaacccacttggtcctagtatatagttctttttacttattcctgacttctatttgctaatattttagtaaggatttttatatctatattcataagagatactggtctatatttttcttttttatactatcttcatctgattttggtatcaagttaatactggcttcataaaatgagttgtgatattccctccacttttactctctggaagagtttatgtaaaatgtatattaatttttctttaaacatttcagagaattcactagtggaaccatctgtcctagagctttatttttctagagtttttttactataaattgaattttcttaaaagttacagggctatttatctattttatatatggttaatgtagtattttatgctttttgagaaatttgtccatctcatctaagttgtctaatttatgtatatagatttgctcctagtattctcttattgttattttctcgtcttgagagtctgtattaatacgcctgtttcattcctgatattggtaatttccatctttttttcagtcttgcttaagatatttccattttatttatcttttcaaagaacaagctttttgtttcattgactatctctgtttttctgttttaaatttcactgttatctgctctttattatttcattccttctccttgtttggggttcattttgctctttatctagttcttgagctggaagcttgttattgatttgagacttttctaatgtaaactttaggagcactgatttaggtgcattccatgaatttgatatgttatatttgcatttttattcatcttaatgtatctttttattttttgagatttttttcttttttttttaatctatctaacactaggtcttatttcttctatcaaacttcatatgtgcccatcaatcaacttctcatctttccctcctccccactacccttcctggcccctggtaacaaccaatctactacctatcctcatgagattcacttttttagcccccacattatgagggagaacttgcgacattcttccttctgtgcttgccttgtttcatttaacataatgacttttagttccatccatgttcctgcaaatgataggatttcattttttaatcagtgaataatgttccattgtatatagatactgcattttctttatccatttgtatgttcactggtacttaggttgaatccatattttagccattatgaatagtgctgcagtaaatgtgagagtgcagatgtcttttcaatatgttgatttcccttcttttggatatatatccagcagtgcaattgctggatcgtatggtaattctatttctagttttatgaggaaattccatactgctctccatagtggctctactaatttacatttccaccaacagcgtacaaatgtttcctgttttccaaatccttaccagcatgtgttactgcctgtctttttgataaaaagccattttaactggagtaaaatgatatctaattgtagttttggtttgcatctatctgatgattagtggtgttggccatttgaatgccttctttgggaaatgtctattcatatagtttgctcattttttaattgaattatttgttgtttttgttgttgttgttttctgtcaagctatctgagctccttagatagtctagttattaatcctttgtcagacaggtagtttgaaatgttttcttccattctgtgggttgtctctttgctttcctgattgtgtcctttgctgtgcagaagctttttagttttgtataaccccatttgtctatttttgcttttgttgcttgtggttttgaagtcttagacaaaaatctttgcctggaaagatgtcctggagcatttcctcagtgttttcttctagtagtttcatgtttcaggtcttagatttaagtctttattttgatttgatttttgtgtatggtaaaatataggggtctaatttcatacctctgcaagtggatatccagttttctccacatcattaattgaaaagacaggtctttccccattgtttgtttttggcacctttgtgaaacatgacttggttataaatacatgaatttatatttgagttccttatcttccccattggtctcgcatatctgtttggtgtcagtaccatgttgatttggttactatagctttgtagtatattttggagtcaggtcatgtgatgtgatacctccagctttgatttttttgctcaagattgctttggatattaggctcttttgtggttccatatgaattttaggattgtttttatatttctgtggaaaatgtcattgatattttgatagagattccactgaatgtctagattacattgggtactatggtcattttaacaatattcttcctatcatgagcatagaatatatttccatttttttatgtgctcttcagtttctttcatcaatgttttatggttcttcttgtataggtctttcacttctttggttgaattgattcctagttattttatatctttggagatattataaatggggttgctttcttgatttcttttttggattgttcactattggtatatagaaatgctactgctttttgtatgttgattttgtgtcctgtaactatattgaatttgtttatcaattccaacagtgttttagtggagtctccagatttttctaactataaggtcatgtcatctgcaaacaagtctactttcacttcttctcttccagtttgaatgccctttgtttctttctcatgcctaattgctctggccaggacttccattttgaaaaaaagtagtgacagtgaagatccttgttttgttccagatcttagaggaaaggcgttcaatttttttccttttcagtatgctagtaactgtgggtttgtcatatatggtctttattatgttgaggtatgttccttctatactcagtttgaatgagggtttttatcataaaagcatgttgagcttcattaaatgtttttacagcatatattgaaataatcatagggtctttattcttggttctattaatgtagcatatcacatttattgatttgcatatgttgaaccatccttgggatgaatcccacctgatcatggagaatgatctgttcaatgtgttgttgaacttggtttactgacattttcttgagaatttttgcatttgtattcattggggagggtggcctgggtttctctttttgttttatcctttttggttttggtgtcagggtaatgctggccgcatagaatgactttgaaagtattccctcctcttcaattttttttagaaagtttgattagaattgctattatttccaaactaccatcagagatactataaatacctctacacaaataaactagaaaatctagaagaaatggataaattcctggacacatacaccctcccaagactaaaccaggaagaagaaaagaatgtgtattctgcagcagttgggtgaaatgatttgtaaatatcagttaggcatattaggtctggtgtatagtttaatttggatggttctttgttgattttctgtttagatgacctgttcactacagagagtggagtattacagtcccctactattattgtattgcagttatcccttaagatctattaatgtttgctttatatacttggcagctccagtggtgggtgcacagatatttataattgttatatcattttgctgaattgacctctttatcattatataatctcctcctttgtctatttttacagttgtttacagttatggctacagttgttacagttacagttgttacagttacagttgttgatttgtagtccattttatctaagtataactactcctgctctgttttggctcccagttgcatggaatatcacttttcaccccttcacttacagtctatatgtgtctttagagacgaagtggatttcctgtaggtaacacatagttgagtcttatttctttatccattcaggcactctatgtctttgccttggagaagtgagttaatttacattaaatgttattattgataagtaaggacttactcctgccatttgtcatttgttttctggttgttttataactcctttctcccttttttactttcttcatatgtggtttcagtgattttctctggtagtatcttttaatttgttgctttttatttttagttaatctgttgtaggtatttgcattgtggttaccatgacgcttataaaaaataccttataacaagttattttaaaaagatgacaacttatcttagatcacagaaatgggaacagaaactgaaaaaatgggaaaaatcttttacactttacttccatcttccccacatttagactcgtattgtctcaatttgcatattttatattacctatctcttaacaggttgttgtagctcctattgtttgtgatatatttatctattcgccttcatactggagttatgattgtgtgtccagagttggttccttccggtgggttcgtggtctcgctgacttcaagaatgaagccgcggacctttgcagtgagtgttacagctcttaaaggtggcgtggaccaaaagagtgagcagcagcaagatttattgtgaagagtataagaacaaaccttccacagggtggaaggggaatcaagcaggttgcccctgctgactagggttggccagcttttattcccttatttgtccccgcccatgtcctgctgattggtccattttacagtgtgctgatttgtccattttacagagggctgattggtccattttacaaatctctagctagccacagagcggtgattggtgcgtttttacagagcactgattggtgtattttacaaacctctagctagctgtagagcactgattggtacgttttacaattctagctacagagtactgactggtgcattttacaatcctcttgtaagacataaaagttctccaagtccctggttgacccaggaagtccagctggcttcacctctcaatgccccctttagacaggacaccccaactgctgttgggaattgggcgatgcttgctctagctacttcctgctggaaaggggcacagaaggggccctacagtggtagtgtcctccagaggggaactctctaggccagccaaagggtcagtgggttggtccaggggtcctcggtagaagttgttcattgagctcatttggggttccattggtaagacatcttactgcttttaggattctgtcttcattcatgacctctgattgattattgtatgccttggagtagtcttatttgggtcctatccatttggtgttctctgaccttcctgtacctgaatatttatatccttgtgaagatttggaaagttctattattatttctttgaataagctttctaccccttgatcttcctcaactccctcttgaacatcaataaaataatttctagatttgttgttttgatgtgattttctgtatcttaccggtgatcttcattgctcttcatgctttttgcttttttcttctctgtgtattttcaaatagcctatctttgagctcactgactctttcctctgcttgatccattctactgttgagagcttctaacgaacttttcagttgaacaaatatatatctcagttccaaggttaatgtttggtttttaattatttcaatctgttcattaaatttttatcataaattttgaattgcttttctgtgttaccttggagatcactgtgttttcttaaaactactattttgagctcttggttagggagctcacatattgctgtttcattagggccagttactgtttcattgctctgtccacttgggaagatcatggtttcctgtttactattgtttcttttggatgtatgtacatgtctttgcattggaggattagttatatttattccagtgttctgtctggcttgtttcgcttttttgtgtttgttttttataatctcaacttttagattcaggggtacatgtacaggtttgttacatgggtatatcacataatgctgaggtttgtggtacaaatgatcccatcacccaggtaatgagcgtagtatacaaaaggttgtttttcagcccttgccccgctccctctctcataccttggtagtccccagtgtctattgttcccatctttatgtccatgtgtaccaaatgtttagctcccacttacaagtgagaacattcagtatgtggttttctgttcctgcatgaatttgcttatgataatggcctccaggtacgtccatgttgctgcagaggacatgatttaattccttttatggctgtatagtattccatggtgtgtatgtatcatgttttctttattcaattcaggatatatttgattcgaggcttttttttttttttttaccacttccccattttcagtcctaggtgacacattatccccaggttcacctaagctctagtaaatgatcagaatgctacccttctcgggtgagggaggtgaaacatggtatatccttccagtgtaggaaagctaagccagtgtttcgtgcccagggaacctgtgggatgcacctcctacagcgtggtactgctgaacagccatcatgatttagcatctcctttggctgagtttatgagcagagtttccagggtcagagactataatcccacctcctccctttgtctctgcctatcctcaggtatatttgttccttcagacacttgtgatgcttcccatgggttaaggcagggacaggtctactgccagggcatgcaaaatgatggaaagctggctgttcaccttgatctcactttttccaatgttaaaacagtaagttagaggaaaattttctacatgcttcgtgcaaggcaggatggggaggaggaacatcatggatgtggaaatctgatattcttactgtctgttcagagttttttcacttctttctggccccagggccacatctcatcttcatatttgagttctgggatatttctagtgatattctctgtgctgttcatttgcttttggtttcctgttgagaggagtgaagtcagcctgctcgtacattgccattttgaaaccagaagtctctggtttcttgagatttcctctttgatccatagattattcagaagtttatggtttagtttccaagtgtataggaattttcctgttatctttctgttactgatttcaactttgcttccactgtggtcagagaagttactctataatttcaattcttttaaatttgtttaggtttatttttatggtcacagatatggtctatattggtaaaaacaatgtgtattattctgtcagctggagtgttctacaaatatcaattcgatcctgttgatttgtgttgctgagttcttctatatgcttgctagttgtctgtctagtcattctatcatataccattaaagtgacttgtatccaaaatatacagagaacttctagatatttaaccaatttatgtgaaaacttacatccacacaaaaatccacatgcaaatgtttttaacagccttattcgtaattgccaaaagttggaatcaaccaagatttacttcaataggtaaatggataagcaaattatgctgcatccatacaatggactcttattcaataataaaaggaaatgagccatcaagcaaccaaaaaagacatccttacatgcatattgctgagtaaaagaagccagtgtgaaaagaatacatattatatggttctaactttatgacattgtagtaaaagtaaaattataagaacagtaaaatgatcagtgtttgcccagagtttttgaaaagaaagatataggtgaatggataaagctgaacagattttttagagcagtaacactatttgatatgaagtagaaatacggaaacatgacattatacatttgtcaaaactcatagaactttatcacaaggaaggcttaatatatgcaaattgcatttgatggatcccagaaagcaatgaggactctgccaagagaatttaaatgcattacaaaataaataaaacaacctcatggaagcgggtggaggggaaaagtactgacctaaataactttggatatgagtggagtctgtaagactaaaggtaaaagcaactgcacataagcgctttagttgataaagttgtatcccatggaggtatgggttaacaattctaattttaatatatatgtatactggaattgaacagttaataaatggatggcaggtagtgagacaggtttctcactgtcacagtgggaaatcacatatgtacaagcaaggggaagaggctagaatgatccatgtgatcctaggtaatgaattagagttggagacatcagtatgaactcatatctagctttaacatagatacaaatggttacatacagaaatatttgttttatatatatatatatgcacacacaggttagtttacacacgtattcctttgctttgtcagcagagagggtctaaaataaatgacatatcaatatgaaatgatataattaatgctgaaatcttagtttttattaccatttggcaataaaaggagcctgggttccttggagaagtggctgattctgggaccaaggcaggaaatatacaagatgaacctggtatatctcgtagtgcttaaaagtaaggaagcactcaagaaaacaaactacaacaaaacacacattggcgggtatatattaaaggggcataggagtcaattgacatctcccgatgaccaaagatgtaaaaatgtgagcaacaaaataagcaacaagcagtatcttattataatccaaagtataaaataaacatccatgactccatgcttatacaaataactttttgcacaaattaattcatgagggagaagagacaaatgtcctgtgcatataatttccaaataatttatatagatgctccaccctcaaggaaggggcacataactcctcacttcttaggcatgggctacatacagtgacttccttccaaagagtacagaactggggtcaggttggggaagagtaactttgctatggggagcacctgacaaatacctcagctaagagatcaagatcagtatcaacattcattagtcagattgatagcatatacctgtgatatgatgtaataaaaatggctgtatatctctatagtcttcttccaaaaatcccataaccctaatcttatcatcagaaaatatcagacagacaccagaagtgggcattctgcaaaaaaaaaaaaaactgaccagcacttaccaaagctatcaaggtcatcaaaaacaaggaaagcctgagcatctatcactgccaagaaaagcataaggagacatgacagctaaatgtaatttggtaatctgaatgggatcctgaaacagaaaaagggtattaagtacaaagtaagaagcatgaataaactgtgggctttagttaataataatgtgtcaatattggctcattaattgccacaaaggttccataataatacaagatgttaaatgtaggggaaacatggtacagagaatatgggaactccctatactatcttctgcatttttctgtaaatccaaaactgttcttaaaaatgaagtcaatttaatcaaataataacgggatattctatacaactgtcaaggagcaaatgatttcaatattatttaaattgttcctgagtgtagtaaaacgtaaacatttctcaattcatgttatgagtctgggataatcttattacaaaactagaaaatgatagtagaaaaaagggaaaatgtaggtgaatattcattgtgaacatggatgtgaaaacttcaaaaataagatactaacatatcaaatctaaaagtatatttttaaaagatacatcaggataaagatggatttatttcaaggacacaaagatggttaactgattaacatgaatcactgcattaacagattaagggagaaaagtcatatgaccttctcaattgatgcagaaaaagcatttgataaaattccaaacctgtttatgaataacgactcttagcaagcaatgattcgaagggaacttccttaatttgacaaagcaaatatagttaataattagatattgttagtattctctttaaagttaggaataagacagagtccaagtatacttctgtccaatattgtacaaagtaaaaaaaaaatgatacaagcattgaaaaggacaagtaatctcccatgattactacatgggaattattaaaaaatcagtagtcttttagaagtaatggaagagttcatcaagtttgttggatagaagatcaggatacatcagttgctgtcctataaacccaaggtgtattttttaaagggaccaaatttcatatttactgtttatttcatgatgtagagattgtaactgtaacagtttctgagcattcctcatttcatcaaaatggatttaataaatgtctaactggtgaagatactgtattaggtgctatacaataggttctatgcagaatcgaccctctagaagtttataattttggggcaccctgcactaacagacggaaatacactaactgcagaacagaaataataagccagtacatatatgaacactaaaatgtttagatttaagtttaaaattacaaataaagagactttatctcaacctttttattgtgaaaaatttcaaacatataccaaattgaaagaattttacagtgaatacttaagattctactattaacattttattgtagttgctttatatctgtcatctattcggccaaaagaaattaaaaaagaaaaacactgacaacatctagcattgtcaggagaagcagcaacagtgtgttgataggaatgtaaattggtacaaacactatggaaaattacttttatacagtaaaactgcacatctgcttattcctgtgactcataaaatctgcttctagctatttaccctagaacattagctttcaaatgtttttgaccataagccacagtaagaaatgtacttaacattgtaattcagtacacacacacatatgtatatatatgtctctatgtatgtgggtatgcatatatgcatatatatctacataaacaatatgcacacacatacatatacaaaaggcacaaacttttctgagtcaatatttatcctaacttccaggaaagcattctgatattttctgttctgttcttttttaaaaaatgctagttatggcaactgaagtcagtttactgccctgttaattggtcgtgacctacaatttgaagaacactgtcctagagaaagctgtgcacatatgtaatattgtgcagcattgaaaatgaactatagctatgcatatcagcatggaggagtttcacaaacacagtgttgagtgagaaaaccaagttgtataagaatatgcacagtatgatttcatttgtatataaatttcaaaagcatgctaaaatgaaaatatatttagataaacatatgtggaaaagttttttttaagtgaatgatttatataagcaccacatggatgaaccttgaaaacatgttaagtaaaagaagcaagtcacaaaaggtgacatattatatgtttccctttatatgaaatgtctagaataggcaagtctgtatggacagaaaatagcttagtgaatgcctagggctgggagttgcaagaaaatgtggaatgactgctaatgggtatgggatttttttgtggagggtgatgaaaatgttctaaaatggattaccaggatgattgtacaactctgagaatatactttaaaaactattgaattgtatcctttaaatgggtaagttgtatggtatatgaattttatattgatagagctgttttacaaaaaagtaagaatgttttaaaattcaggataatagttatttggagaagaagggacttgagatcaagtcaaggcacgcagtactctttgaaagtatcagtgatagtctattgcttcacctaggtagtaggcacatcagtgggatttttattgttattgtctgttttatacacgtcataccttgttgtgtatttaatatttaacagaaattttaagagaagcaatatttttcatattcttctattctcatgcctgttgtgatcaagtttaacatagaatattgaacttctagtgtaaatctagattaggaccagttttcatccaaatatgtcctgtttttaaaaattactctttttgtattaaactttcaaaaaaattggaataaaaaggtaactatcccattatatagtctgtgggtcagaatattcttaactataacctgttcgcttttcttcatcacctttgcaaccaccctaattcacctgttacatttttcgacattctcttaactgtattccttgcttcctttcttgcacctctccaaacaactttctactttgcagccagaaatatcttttgaaaatacagatattagtatgttatttctctgctcaaaattttttagcaaaatctcactctccactgtagataaagactgaattctttaagattactttccagggcctatatataatttgtcactgctgctttttgcatcagcttccacccacacttgttgttgtttttaccacacatatcaggttctattgttagcttctgagtactttgtacatgcccttttctctgccttgaatgttcttccttctctctttacctctgtaacaactaccagttcttcaggcagaagcttagattttttccttccttatagaagccttctcttaactacccctacccttccttacctaagactaaaatgcccttcctattgttcccaaaggatttttgcttaatatacatttacatttatttaaaatatgctttatattttatatacataaacaaaaacaatgcgctatgtaacatgctgaatcagatacatgagagaaaataaactaagaatgagtcaactcgtatttagtgttttttgttatcagactttcttttctttatatcttctgtcatcccctttcagttcatcttagactattattcctgaaatagtgcttggtaatattagtaatagcagaatccatgtatcatctccaatgccttaagaatacattctagctctttacagtgaattcatgacttctactgtcttaattctaatgtactttttaaggaaagatggaccaaatatttatttaatgcctattatgtactagattatactgtaccttatatttcaaagattatgttaacccttttaacaactcaggttatggaaactaaggattaaagaagtttagtaatgaagacaggattacactaatagtaaatagtagtaccaaaactcaagcacagtttatcacagcagttctcaaacttttccatggatgagagtcaactagagaacttgttaagatacagattactggaccccaccctcatagttttttatccaatatatcagcaacagagaggaggggataagggtggtatgggacattttgcctttccaacaaattcctgtatgatgcatatgtttctggtccagagaccacaaattgaaaaatactaatctgtcagacagcaacatctttccactggtccttcttagcctcatattactcctctataagtaagcaagtggatgcttgctggtgagagacaatatactcaaaatgcacttggtgctttttttaactctatgcttttgcattatttttcccctcctcctaaactgcccttctttttgatttttgttttgttttgtttttttgagacgaagtcttactactgtcacccaggctggagtgcaatggcacaatctctgctcattgcaacctccgcctcccagattcaagcgattcttctgcctcaggctcctgagtagctaggattacaggaacctgctaccacacccggctaattttttgtatttttagtagagacagggtttcactatattggccaggctggtctcgaactctgaccttgtgatcctcccacctcggcttcccaaagtgctgggattacaggcatgagccaccacactggctacttttttttaacctatggtactttataccaatttgtgttactacttactatcttgtgttgtagttgtttatatgctttaatgttctacattttacaattataaacttcttaagcatttgggttgcatttattccataatacttagtacagatctttagctatttgataaatattggaatatgctaaaactttggtgcttatagtttttaaattattgaatgatataatgtttgtaaaaatactttattaatcctaaagcattatatagaggaggagtactttcttcttgcagtgactctggacattctatagatgaaaaagtatgtcttaaaattaatttttaaacacttcaaagagatcagggaaatgagaaagaatacataaatctctgatgtaatgttttgacaaaatagtaaaaaaaaaaattgatgggaaataacaaatgtaatctcctggctgtatagaaacctttaattatatcacatatgcatacatacacacacacagaaaaatagtggtctggatgtaactgttggttatattagcactgctactaaggtgtcaacctagagcaagtgaagtattattggagacataaaaagcctggatttgattaccaaaaattggaataaaaagaattaactaagttttcacttgccactaaccttctaatggagggagttacaacattcttggaaaataaaatccaacacatttcataacgtgataaaattgttacagtgatgtcagtaaggataagttaatggacattaataaacacaagatggaatgaacttactggataaaattacaaaaatcccagagctatgtattaatcaaattctttgtactccaaattatttttccatattttgtaggtaactatatttgtctttccttcatagaaatattgggaggataatatgcagtaattgttatggtaatatttctagtttttagaaggaaaggtgctacaaacttccggatgtagctaatactatattctacgagggattattgtgctcttagttaaaattctagatttattcaataaattgctagatttgcttacatgaaaatagagaacttaatattgatgacattccaatcatattactggtgatattataatcaattagctatcatattgacaaaaagctaaaatgtagcattttagtttggaaagaaaaacaaaattcctaagtaaacaggaacatattaagaactatataattacccagtgccattttgtcactaaagtactttatccaattctgactgccagaactaaaacagattttgaagaaatatcattaagattaaaggtcagaaaatagccttaaagtttttaatgaaataatgaatagtttttctagtaagaagaaggccagcaggtgattcagtaaacattttcagatatatggaaagttgtaaataaatggcaatcttctctttcagattgtaagtaggacaagaagaaaaagtaataaaatataggacagttttaggttatttcagagaataagagtggttaaagaaaaactcagtcaagacatttggggaagagtgttcttacattactttaaaaatactgtaaaattttaaaaatagcataatctctttgttttcaaattatgaaaatgagataatgttaccagatcagagtaacacaaccagtcaatgacagcataattccagctctcatatgaaaatctaggcctttgctccttgactccagtcttccactgcttttccatttttttatgtttcttaaccagttagtttaaatgtagcctggaaattgacaattatctctgaaagatgtttctagcttaaaatgcctgtgattatcagtgggtctattaatgaatgagctctccaacctcttcccttctgccattcacttgtgaaaaaccttgttttactttaaaacttatagacttcctgagaagcaagagctcaaatctaaatcttaagtgctttttgtgttagacttttgaacataaatatcactaggcatttttaatgcactatctcaaactcttaaacaattgtataaaatatgaagaagctgaagttagacaaaataggtaattagacttggtcagattgcttaaaagtaggtaaattattctgattccacattcagtacattttttccaatttgccatactaaccataatgtaaaaacttcaaccagaatgcctaatttgtatagcaagcagtgaatgtcttaagataacacttttattcctaaaacagttgttcacatgtaaagtaaaatgattgttatttgttcttaatgtatttaaaccgggcattcatagcaatttagtgttcatctactttctcttttctttcaggcctgtatgtggaatcagagggaaaacgctcataattaacctgccaggtagcaagaaaggatctcaggtaaatcacctggacatattaatggtttagtgtaagagcttttgaccagccgtgaaagttagccagccaaaaagttggagcactccacaagactgccctcacatctgataccaattgcaggattcccaaagtcactcttgggttcagtaattcaatggaaagacatagaactcactaaaaactgttacacttacagttatggtttattatggggaaaggatacagattaaaatcagccaagagaagaagtgcataagacaacgtccaggaatactaccaaacacagagagcttcccttgtcctctccttgtagagtcatcaatgctttactctcctggcattcgtgtatgataatatacttgtaatatttttaatcagagaagctcacctgagtttttgatgtccagagtttttttttttttttttggtttggtttttttttttgttttgttttgttttttttgcagttcattatattttgcccatgtgaatgacctttagtctttagcgcttcccagagattggattgatagcattagtctccagtatgttccagaactgacaccatgtggccaaaagtccccatcataagtcatattgttagattgtgtggtggccaaagccatcaggtaaacaaagacactgctgtcacacatgacattctgaacatctagagatctcctccaactagttaagggcaactacttttaccctcagactctctttgggtactgttaattctttgctgtacaagctaccccctggcctttggccaaggctttttttattgtatagcaacacagtcatgtttgtctgggcatctatatttactatggtatttatgtgacagacacagcagtagtatcagtgtgaatatgcctaagatttggccaaggcagtgtagggtgtggatatatttagagaaatagctaatccatccactaaagccattacatacattttcataattttgtattaagttactaatttctcacctttaatctaccactattgatatgtttgtacagaactatatatcatagaaattagctgatggttacctaagtgcatttcttcctcaggccagtcattttctattaacattatatcctgaggaggctttaactgaatttcccaatacacttagccataacctaaaaaataaaagtcaaaagatactggcacgttcttagagtccttctcagacattaacagaccagaatgtctcccagaatgatgctactcaggtttgcaggcttgttggattccaaaaataagagtggtctcagcaacatatgacttcactctttcaagcatctgttacagttgagctaagaaacaatgtcatctcttgttctgaacctctttggagataccaatgcagtattatttcccttactgcataacctatccattcattcctttaccctcagctaccattcttccttctctctatttatacccaaactttttcaccttttaaagagttgtaaggtttggccactgtgctgattcagattgccgttggtaatactagtttagcaagttcctcctgcacagtctattcctattcatttagagtaggattgtatcccttaccttcattttagctagcatagataacaataaccaagagattgtgtgtttaacttctttctttatattttgcatctccttatgcatccagtgagataactttttgggaattatctccattaactaatcacagtaaagaagcaattccatgctgtggttgacactgtcttcactcagggatcaaaggttcatcatcccacaccctctcttcacttcctaagccatgtatttcagtgagtcagggtctttctagaaaatcttatttttgacaccaactgtaaggagttttagccaactgcaaaaaatagccacctacaaatgtggagtactccacaaaattgctcatttctgaccctaattgcaaattcaggagatcctaaaatgaccttcaggtttaataatttactagcattcatggaactcacagaaagctgttatactcatgattattgttcattgcaaggaaagaatacggattaaagtcagccaagggagaaagtgcatagggcagagtctaacagaagtaacaaatgaggaacttctgttgtcctctctctttggagacatggacatgtcacccttctggcgtcaatctgtgataccacacatggagtaatgccagctggggatgctcacctgagcctttggtatccagagcttttattgggactcaaacacttactgccagtgtggctgacctgtaatctttaatcctaaagtagagagaagcaattgggggccttctatgtagaaagtggggtcagaaggccaagaaagggagtatgagtatatatccaagtcacttaggaacttttatgcaggtgcaaaaaaacttatgtcaaagtggccacaagattatttaatagacagatgaatgaaagtccatgtttactgctagacacgaaagctttgtgtgaaatcttgaattaatggggagagagggagggtagcctatacctgtctgttcttttcctgatccctttccctcattcctgaactgcagtctaacattgttagactgtctctggtgcccaaagtccatggacaacaaagacattcctattaggcgtgaaattccaaggacctagagatcactcccagaagctgagtgtaaagaccagacctctcctcggtcaaggttaaattctttaccacacaatctttaaagagtaaactgattgagccatacaaagataggtcgaaagattaaacatctttcccgatattatgtaaccctccaaaaatttttaagatttttttttttacatcttagattttaagctattacttcaaatgtgaaagagaaagacctccacctcttctgcagctatagctggccttatattctgatttttaggttcttacctattctcttttggtaatacgttatagataatagtgagcacctcagcagcagattatattaactttatgcagtgctctttgcaagcttattttatattttgcttgctgtacaatgttacctagctatactttatgatggtagttagaactttagctctctggacaaaataatctggttctcacctcggttgttagttctactgccctgctctaactaaaaatatgaaacctctttcctgcctttttttaaacaacttcagtaccaataaatctttattcattgtattttcccaagaaaaggagaagggataggaaaagagtcagcatgtgtgttaaaaaaatgattagaagatgggaaaagaagtagagaatacagcaaaatcaaccatcaaataaacataccccagtggtggggtcaccgaagcccaaacgggctcaatctcctgcagttcaagaatgaggggttgggattaggaaaataacagacaggtacaggctactctccctccccataaattcaagatttcacacaaaggtttggtgtctagcagtaaacacagagtttcatttgtctgtctcctattaaacaatcttgtggccactttgacataagtttcttgcatctgtgtaaaagttcctgagtgccttggatataaatattcatattcttttacttagcctcctgagcccactttctgcatggaaggcccccagttgcttctctctacttttggattaaagattaagtagatttggccaggcgttggggctcaggtctgtaatcccagcactttgggaggccgaggtgggccgatcacaaggtcaggagttcaagaccagcctggccaacatggtgaaaccccatctctactaaaaataaaaaaaaactagccaggcgtggtggcaggcacctgtaatcccagctactcaggacgctgaggcagagaattgcttgaacccaggaggcggaggttgcagtgagacaagatggcgccattgcactccagcctgggcgacagaatgagactccgtctcaaaacaaacaaacaaaaaaaaatggttaactagatttgacccatccaagatacagcagtgtcttaagtgtttggcatgaatcacatcaagaaatggtcttgactcaggaggttgggaacaagggatgaagggctcctagtttcttcaggatttttgcataaatcatttaagagttgtagaaataacgcaagaattaaatgtgtgtatgtgagtatgtaagttttctcttggggaggaggggatggaaaagagggtagtatacaagtttttagaatgtatttatttatttatttttagagacagagtctcactgtgtcaccctggctggaatgcagttacacaatcatagctcactgcagcctcaaactcttgggcttctttcctatctttcctgtctttctcataatgcatctttcaactaccaagttgtatatagaaattttactttttttaaaatgcagtgcatgctttttttttttttagagaatgaatctgattctgaccatccatgcctgtcctcagtcttatttttttttatttttccataagttattggggtacaggtggtatttgcttacatgagtaagttctttagtggtgatttgtgagatcctggtgcacccttcaccgagaggtatacactgcaccatatttgttgtcttacccctcaccccccacactctttcccataaattcccataagtccccaaagttcattgtgtcattcctatgcctttgcgtcctcatagcttagctcccacatatcagtgaaaacatacgatgtttggttttccatttctgagttacttcacttagaataatagtctgtaatctcatccaggtcattgcaagtggtgttaattcattactttttatggctgagtaatataccatcatatatatataaaatagtttctttatccactcattgattgatgggcatttgggttggttccacgattttgcaattatgaattatgctgctataaacatgtgtgtgcaagtgtcttttttgaataatgacttcttttcctctgggtagatacccagtagtgggattgctggatcaaatggtagttctacttttagttctttaaggaatctccacagttttccttagtggtttcactagtttacattcccaccagcagtgtagaagtgttccctgtttaccgcatccatgccaacatctactgttttttgattatttgattatggccattcttgcaggagtaaggtggtattgtattgcagttttgatttgcatttccctgatcattagtgatgttgaacattttttcatatgtttgttggccgtttgtatatcttattttgagaattgtctgttcatgtcattagcccactttttgatgggattgtttttttttttttttcttactgatttgtttgagttcgttgtagattctggatattagccctttgtcagatgagtagattgtgaagattacaaaacactgctgaaagcaatcatagacgacacaaacaaatgtaaacatatcccatgctcacggattagtagaatcaataatgtgaaaatgaccatactgccaaatgcaattttcaaattctatgccattcccatcaaaataccaccatcattcttcacagagttaagaaaaacaattctgaaattcatatggcaccaaaaaagagcccgcatagccaaagcaagactaagcaaaaagaacaaatctggaggcatcacattacgtgatttcaaactacactataaggccatagtcaccaaaacagcatggtactggtataaaaataggcacatagatcaatggaacagaatagagaacctagaaataaaatcaaaaacttagagccaactgatcttcgacaaagcaaacaaaaacataaagtaggaaaaggacacccttttcaacaaagggcgctgggataattggctagccctatgtaggagaatgaaactttatcctcaactctcaccttatacaaaaatcaactcaagatgaattaaggacttaaacctaagacctaaaactataaaaattatagaagataacattggaaaaacccttctagacattggcttagacaaggatttcatgaccaaaaacccgaaagcaattgcaataaaaacaaagataaatagctgggacctaatttaaactaaggagcttttgcatagcaaaaggaatagtcagcagagtgtatgttttttttttttttgtcactgtaactatttttattacatcacaataattaggagtagtacagttcatgacaaaaatattacaaattttagatcatttcacagcacatactcctataaacatttaaaagttaatttcaattaaaagagtggtcatttttaatgtttcatatgaccaacattgtagcactgtagttccttagcttatggagaatgctataacatattttatgcttacttcatggcatattgctaagacaatgttttacatatgattgattctgagattgatggaggaaaatgcaaatccaaaatcacgaaacagtttgattgccaccatcttatataattacaaaagtgcttcatcttaatttttttttctttctcttgcatacaggaatgctttcaattcatactgccagctctacctcatgccattgaccttttacgtgatgccattgtaaaagtaaaggaggtgcatgatgaacttgaagatttgccttccccacctccccctctttcccctcctcctactaccagcccccataaacagacagaagacaaaggagttcaatgtgaggaagaggaagaagagaagaaagacagtggtgttgcttcaacagaagatagttcctcatcacatataactgcagcagccattgctgccaaggtaagcctgatgagagttactcagaggcctaaaggacccacaggtaaatgtactggtttcatctgttttgcatcgcatccctccctacatttaatacttcttcagagaaccctaaaaaaataagtgggatgtccatgacactccactactatgtttccttcttgatatagattccttgaagtcactgaagttaattctgagttctgaggcattactgatgagctgttgcctattgaagtaatagctacaatgataaacaacgtgacattttagaactctttggagatgtcatttttgtggacatattaaatatataatgtttatatattcaaagtatcaaaatgtcacaaattcttaaaggaacagcaaactgaaggtaaaagaccttagatgattcaagaaatgagttgggaaagattaataaagatttttaaagggacaaagcttttcagcgattgttgaatttttcttaactaataacttattcaaacattgcttgacacaaattaccctagtggtaaagataggaaatggatatatttgcatttctactttaagaaatattattaggacaatatcaaagtattacaaattctctttgggcaactccatgggtaaatatactaccatgagttacttgagtaaatttaactgtcttaaagttatagaacatggtttattcttcatacctactaaagtcaacctagtatgccttaatatctacagaaagtagcatatcaattctggaaattatgatttttcattaagagcataaagattgaaaatttaattgctatatgacataattatcagattttatggattatccagttattttggctacgagcattgtgaggttttttttttaataatatatagattagaatcatcgagaaatccttttgaagtgtccattcagtgatccagtgagtgcttactaaaggctagtaagtatttaagttttgtgtgattttttttttatgaaaccaattggtgaaacaggcatttttaaatcattatatgttccttttcctttactctgaattaaaagagtaagaagtgccataaatttcaatcttaggagagaagcttatggcatttaaaatctaagctgattctgtcattctacatttggaaaatgttagcatttcatttttccatttgtttttaccttttttcctttttagtcattttgcttgtatagtttcatgttttcctgtcactatattcatagttgttatgtgttgtgcattagaagcatccattctacaccagtcctgctgttgtcatggcacacggtgaacagcccatccctggtctcatcaattattcccatcattcaacagatgaacgggtaagacaagaggcttttgcattaatggttttccaaatatgtattctacttcctctccttggagataggctgtaacatatggaagatgtgttgttttattctgatggattttcagccttgctttcttgtgaaagtgtgagtgccattgagtatatccatcaaggaatttaatagagtttctcctgtgactaaagtactctgctatcattaagattctgtcatttgtgacaatgaacttttatcaaatgacttgcaagaaagtcattgctcagaagttatttttgtcttaccaatttcatcagatatctttaaataaattgcctggcttaaaattacctcttaagagaatcactttgagtcttaaaatctagacagattggtcaagcaaatagttgatttgtattaaccttcctgttttgtcttatgattttgcatctcatttttttttcattcattgagctctcattacaaccattgcagagttgaattttgatataaattctgtgattcctcatcataagtaaactttttaggtgcatatttgtttattcagtcagtggctgaatgatagcttgcaaaaaaatgccaggttgtaaaagattaaactgatacataaaaatcattaaacagtgataatttagacattggatgaaaaaaaaacgatctaagtccctaatatggatgtaaaatgagaggggcagagaagaaaaagaaataataaagtgaaatttggttttaaatacttaggaagcaaaacacccaaaattaggagagaaaaaaaccaacaacttagcatccatagtctcttagaagatactaccaagtgaagactttttaaaaattttaattttgtggggtacatagtagtggatatatttatggggcatgtgagatattttgatacaggcatacaatgggtaataatcacatcagggtaaatgggtatccatcacttcaagcattcatcatttctttgtgttacagacattccaattgtattccctaatttattctaaaatgtacaacaaattattgctgattgtaatcaccctgttgtgctatctagatcttatccattgtatctaactatattttggggtacccattaaccatccctatttcccactccccctacccaccctctccaccctctggtaaccatcattctaccatctttatctccgtgagttcaattgttttaatttttagctcccacaaataagtgagaacatgcaaagtttgtctttttgtgcctggcttatttcatttaacagtgtcttccagttccatccatgttgttgcaaatgacaggatctcattcttttttatagctgatcagtactccattgtatatatgtaccccattttctttattcatctgctgatggacactcaggttgataatgctgcaatacacatggaagtgcagatatctcttcaatatactgatttcctttcttttggatatacacctagtagaggcattgctggatcatacgtagttctgtctttagttttttgaagaacctccatactattctgcatagtggctatgccaatttacattcccaccaatagcgaacaagtgttcccctttctccacatcctcaccagcattcattattgcctgtcttttggataaaagccgtattaactgggaagagatgatatctcattatagttttgatttgcatttatctgatgatcaataatgatgagcaccttttcacatacttgtttaccatttgtatgtcttcccttgagacacatctattcagatcttttacccatttttaaattagattgttttatgttttttcctatagagttgtttatatagtctggttattaatcccttctcagatgcatagtttgcaaatattttctcccataccttggattctcttcattttcttgattgtttcctttgttaggcgaagctttttaacttgatatgatcccatttgtttactttttcattggttgcctgtgtttgtggagtattactcaagaaatctttgcccagtccaatgtcctggagagttttcccaatgtttccttttagtggtttcatagtttcaagtcttagatttaagtatgtaagtctttaatccattttgatttgattttttatatatggcaagagataggtgtctagttttaataatctgcatatggatatccagttttcccagcaccatttattgaagagactgtcctttccccaatgtatgttcttgacccctttgtcaaaatgagcttactgtacttatatggatttgtttctaggttctctattctattccattggtctatgtatctgtttttatgccagtaccatgatgtattagctactatagctctgtagtataatttgaagtcaggtagtgtgattcttccagttttgtttttatttttgcttaggatagctttggttattctaggtcttttgtggttccatataaatgttatgattattttttctgtttctgtgaaggtattttgatagggattgcattgagtccatagattgctttgggaagtatggacattttaacgatattgattcttccaatccatgaatacggaatgtctttcctttttgtgtgtgtccacttcaatttcttgcaaaaatgttttatacttcatcatagaaatcttttacttctttggttaaatttattcctatgtgttttctttgtagctattgtaaatgggattactttcttaatttctttttcatattgttcactgttggcatatagaaatgctgctaattggccaggcgtggtggcttacacatgtaagcactttgggaggctgaggtggttggatcacctaaggtcaagagttcgagaccagcctaaccgacaaggtgaaaccccgtctctactaaaaatacaaaaattagcctggtgtggtggcaggcccctgtagtcccagctactcaggaggctgagacaggagaattgcttgaacctgggaggtggaggttgcagtgagctaagatcgtgccactgcacttcagcctgcgtgatggagcaagactccatctcaaaaaaaaaaaaaaaagatatgctactaatttttgtttgttgattttgtatcctgccactttactgaatttgcttattagttctaatggttttttgttggagtcttaggtttttccaaatattgtatcatcagcaaaccaggataatttgatctcttcctttccaatttgggtgctgtttatatctttctgttgtctgactgctctagctagcacttccaatgctatgttgaataacagtggtaaaagtgagcatctttgtcatgttccagatcttagaggaaatgctttcagtttttccccattcagtatgatactagatgtgggtctgttgcatatagcttttattatgttgaggaacgttccttctatacccagtttttttagggtttttatcatgaagcaattgaatttcgtcaaatgctttttcagcatcaagtgaagtgatcatacggtttttgtcattcattctgtagatatgatgtatcacattgattgatttgcctatgttgaaccatccttccatccctgggatgaatcgcacttggtcatgatgaatgatgtttttaatgtgtttctgaatttggtgtactagcattttgttgaggatttttacatcaatgttaatcagatattggcctgtagttttctttttatgatgtgtctttgtctggttttagtatcagggtaatactgaccttgtagaatgagtatagaagtattccttccttctctatttttcagaatagtttgagtaggattggtatcggttcttctttaaatattttgtagacttcagcagtgaaggtattggttcttttctttgctgggagactttttattatggcttcaatctcattacttattgctgtattcaggttttggatttcttcatggttcaatcttggtaggttgtatgcatctaggaatttatccactacttctaggttttccaacttattggcatatagttgctcatagtagtctgtaatgatactttgaatttttgtggtataatcatgatgtctcctttttcatctctgattttatttatttgggtattctctcttttcttctttggctaaagatttggcaattttgtttatctttcttagaaaaacaacttttcattttgttgatcttttgtactgttttttgtttgtcttaatttcatttattgctgctctgatctttatttctgttcttctactaatttgggcttgattttctctagcttttctagttctttatcatgtgtcattaggttgtttatttgtagtttttctacttttttgatgtaggtgcttattggtataaactttcctcttagtactgttttgcctatcccataggttttggtgttttgtgtttccatattcatttgcttcaagacattattaatttgcttcttaatgtcttcagtgacccactggtctttcaggagcatattgtttaatttccgtatgtttgtatcatttccaaagttttttttattgatttctagttttatgctgttgtgggttagataagatacatatgatttcagtttttttaaagacttgttttgtggcctaacatatcgtctgtccttgagaatgattcgtgtgctgaggagaagaatgtgtattctgcagccattggatgaaatattccataagtatctattagatctatttgatctgtaatagagattaagtccaatgtttctttttttttttttttttttaagatagagtcttgctttgttgcccaagctagagtacagtggggcattctcagctcactgcaacctctacctccaaggttcaagcgattctcctgcttcagcttcccgagtagctgggattacaggcacgcgccaccgtgcccagctaatttttgtgtttagtagagagggggtttcaccatgttggccaggctgatctcgaactcctggacctcaagcgatccgcctcccaaagtgctggaattacaggcctgagctaccacgcccagcctcaatgtttctttattaattttctgtctggagaatctgtccaatgtttaaagtggggtgttgaagtctccagctattggcatattagggtctgtctctctctttagttctaataatataataatatttgttttatatgtctggatgctctggtgttggttgcatatatgtttacaattgtcatatcctcttgctgaattgattcctttatcattataaaatgaccttccttgtctctttttatagtgtttgtcttaaaatctattttttctgatctaagtatagctactgctactctttttgggtttccacttgcatggtatatctttttccatccctttattctcagtctgtgtgtgctttttttttttctttttttcttttttgagatggagtgtcactctttcgcccaggccggactgcagtggcgctatcttggctcactgcagtctctgcctcccgggttcacgccattctcctgcctcagcctcctgagtagctgggattacaggcgcccgccaccacgcccggctaattttttgtatttttagtagagacggggtttcaccgtgttagccaagatggtctcgatctcctgaccacatgatccgcccgcctcggcctcccaaagtcctgggattacaggcgtgagccaccgcgcccggccgtctgtgtgtgtttttataagtgaagtgtgtttcttgtgaccaacagattgttaggtcttgttttctaatccattcagccattctgtgtcttttgattggagagttaagttcatttacattcagtgttattattgataagtaaggacttactattgccattttattatttgttttgttttgtttttttctagttctttgtggtcttctctttcttccttccttcctgtctttctttttgtgaaagtgtttttctctggttatatgttttaatttcttactttatattttttgtggaactattgttagttttttggtttgaggttaccatgagccttgcaaatactatcttataacccattattttaaaccaatgacaacttaactttgattgctaggagttaagagcaaagagacaactgataaaaactctacactttaaattcatccccccagttttaaacattttattttttctatctatattttataatagtatgtctcaaaaagttgtaggttttttttttttttttttgagacagggtctcactgtgttgcccaggctggagtgtaatggtataatcacggctcagtgtagccttggcctcttgggctaaatcagtcctcacatctcagtctcccaagtagctgggactacaggcacgcaacaccatgaccaactaatttttgtattttttgtaaagacagggtttcactattttgcccaggcttgtctcaaactcctgggctcaagcgatccacccaccttgccctgtctaggtgctagatcacaggcatgagctaccatgcctatagttattattttttagatcatctcttagttgtcctactcaagatatgagatgagtaatttatacatcacacttaacagtgtataatattctgtgtttgtctgtgtatttattgttaccagagagtttggggccttcagatgatttcttatttctctttaatattcttttatttcagagtgaagaacttcctttagcatttcttgtaaaataggtctggtgttgatgaaacccctcagcttttgtttatctgggaaggtctttatttctccttcatgtttgaaggacattttcacaggatataattttgtaggataaaagtttttttccttcagcagtttaaaatttgccattctctcccagcctgtaaggtttccactgagaaatctgctgccagacatattggacctcctttatatgttatctgttatttttctcttgatgcttttaggatcctttctttatccttgatctttgggagcttgattattaagtgtcttgaggtggtcttctttggggtaaatctgcttagtgttctgtagccttcgtgtacttgaatattgatatctttctctatgttttgaaagatctttgttaatatctctttgaataacctttctaccctgatctcagtctctctctctctctctaccttttctttaaggccaatacctcttactgccctttgaggctattttctagatcctataggtgtgcttcattattttttattcttttttcttttgactattctgactgtattttcaaatagcctgtcttcaagcttactaatttttttctgcttaatcagttatgctgttgaaagactctggtatattcttcagtttgtcaattcagttttcagctccagaatttctgcttgattgattttaattatttcagtctcttagttaaatttatctgatatgattctgagttcattctctgtgttatctttcattttgttgagcttcctcaaaacaactatttctaattctctgtctaaaaggtcacatatctctgttactacagacttggtcactggtgccttatttagttcatttagcaaagccatgcttttgtggatggtcttcatgcttgtggctgttcatcagtatctgaatatttattctaatctttgaagtctaggcttgtttgtacccatccttcttgggaaggctttccaaatactcaaagggaattaaatgttgtgatctaagtctggtcactgaggccatatgtgcattagggggcaccccaactctagtaatgctgtgagtcttgcagaggtactctgactcttatagaggtactgccgtggtggtcttaaataagatccaggagaattccctagattaccaggcagagtcttgttcttttcccttacttttccccaaacaaacttaatctccctcttcatgctgaactgcctggagttggggaagggttaatggaagcactcttgtggccaccaccactggtactgtgttgggtcactcctaaaaccagcccagtactgggtcttgcccaaggcctgtggcaactattttctggctgctgcttgtgtttactgaaagaccaagggatctttagtcagcaggtggggaatcctgccaagaccaggttttttttttttttttttttttttttttttttttttcagtgcagcaggtccccttctggcccaaggtgggtttagaaatgccgtccaagagctagggcctgggatgggaggctttaggaatcttcttggtgtttattttaccaggttgcaagacaaagtcctctttacttttccttctcctttcctcaagcagaagtctctccctatggccattatcactctaggctcagggcagctaccgcttggctgccactgatgtttattcaaggcccaagggctttttagtcaccactggtgagtcctgcgaggcctgtatctctcccttcaggacagtgaatgcctttctggcccaaggcaagtctagacatgccctccaggagctaaggttaagattagtacatcaaaaattatttgagtgacccatttttcagttctcccaaggattgtacacaactaataccattctagatgcataggagataagttaattattagggtttaattctttggaggaactagttgagaatgattgtaaaactgttctaactggatgttctcatatagcatcagtgaagactttctcattgattaactatttattagctggtatttaacagtcctttgtaaatagtaattggtcttttgacagatgttcagttttataagtagactcacatgtttatgtttcctgtgacaaatgacagttaacaacatatcaaagagtataatgttgttcttcagactgggcatctatctatacagtagaatgaaaaggaagaaataggtaacagaaaataatgaaaagaaggccttgatgcttctgaagaagttatgttaactttgaatgcttctctagcactaactttattaatgagtcccactggttctgaatgacctggtgtgttgtcagtgtgtcagaagacctctatgtgagaacagtcatttggaatatctatatatactatttggcttacttttacaagttttacctatgtaaaattaatattgaaagggagcacctgattacctattagaaagaaaaattacaatttccctcagctggtcacaatctgaggcatgtgaagcaatgtggaataatgttaaaatcttgtatttagagacggaaaacctggatataagcccttacctcaccacttaataattcggacaagttacttaaaatttaagcttcagttctcatctataaaatggaaataataattatcctgtatctcacaacagattattatttttagtacaggagatgacatatatgaggaaatttttataaactttgtaaattaagaattaagtatttgcagaattctttcaaggtaccaaacactatcctcactgctcagaatacaaatataaacaggttgttccagcccataaaaagttcacagtctagggcctgggtgcagtttctcatgcctgtaataccagcactttgggaggctgaggtgggcagatgtcttaaacccaggagtttgagaccaacccgggcaacatggcaaaaccccatctctactgaaaaataaaaaattagccagacgttgtggcacatgcctgtagtcccagctacttgggaggctgaggtggaagaatcacttgagcccaggaggttgaggttgcagtgagctgtgatcatactactgcacttcaacccaggtgacagagcaagactctgtctcaaaaaaaaaaaaaaaaaaagagttcacagcctagctgaagagttgcttttttaaattacttctttaccttcctaactcagttatctacttctagtaatcaaaaagtgaaacttggtcaatgtactgactgttcagtagttactaatgagctcattgctacttattgcaaaattaatcagcttgctatttcaggagatagagacttaagaaattcctcttgtaattgacatttgttcgttgtctgtccagcagtcattttccattccctcttcctagcactgtaccacatttcccagtcatgtagtttgggtggaattgattaaacctccagtgtaggttgtcttaatactgtataatcaacatacccatttcacctagccacagtcattagttaaaggatcatgtaattcaaagcagtcagagccagtggatttcatctcttatattttaatttaactactgggggacacagattctctgtttcctgctgaacatgaatgaggaaatatacaaccccaagaattacgtcttgggaccgtgaatggaatgcctgctatgatggaactagcataagaaacaatcctgagaaacagaagtttaaaagagatactgggtcccagtaacattttgtgaaccactcattcaagcccttcttgaactatacagactgcttgactttttggttacatgagccaataagctaatagagataactgttgtccataactaaaaagtatcttaactattataatatacctgaataagtactgtatcatcaaagaaataagacattttcctaataatgactaaaatgtatcaaataggaatccctgaagtttcatatttcagtaaaaaaacctgattcaagaggatagagggttggaaaatgtgacttaaaggaggaagaggatgaaaataaatcctgctcctctgtatttataaaataaatgaagatattttcagagagactggatccaaatctgaaggtgacaacttatgctttgcagcctcaaggcaactgataggttcaaaactcaaagtaataatattaacaacaggcaaagaaagaatttaagacaaagagggaagctatccttggagatttgtaataggaaatctcatttcactgacagaaattaaatcttctggagaaatccaaaacaataatgatgctccctaagctgtattgtatgaaagaacatctactgattgccctgggaagaaaaagagttggtgacttcttcttggtaaatgatacggaaaaaacaatatttttatccatatcatttgtatatatattatatatatatgtgtgtgtgtgaatatatatatgtgtatatgtatatatatgtatatgtgtgtgtttttatatatatataaaacaaacatgctgtatgttatgtttatcaaacatgtacatatacatgtatacaccaccgcatggtggctggcacctataatcccagctacttgggaggctgaggcaggagaatcacttaacatatatgtgtatacgtgtgtttatgtatacgtatacatgtgtttatatgtatacatgtatacgtatacatgtgtttatgtgcacgtatacatgtgtttatgtatacatatatattaaaactatatatatacagttttattgtttccttttatccatgaggattttgagatattaaaataattatattaattgaataccaatcattctctaagcattttatatatatcagctctttacgtaaatcctcattttgcttgtaagaaatctgaagctcatggtagttaagaacatggaactacttagtggctgaactggtattcaagtctaggcagtctgattctaagatgggaattcttgactactctgctatagcacctttcataaaagaaaaagtaaaagaagacattttgggaggtgacaaactaattataaactctcctcaaaaatgagaattggggtccaggtgcggtggctcacgcctgtaatcccagcactttggaaggctgaggtgggcggatcacctgaggtcaggagtttgagtccagcctagccaacatagtgaaatctcgtctctactaaaagtacaaaaattagccaggcgtggtggcgggcacctgtaatcccagctactcgggaggctgaggcaggagaatcacttaaaccccggaggcagaggttacagtgagcagagattgtgccattgcactctatcctgggtgacgagaaactccatctcaaaaaaaaaaagaaagagaaagaaatgggattttttaccatggtttgaaatacttaagtgataagatgcactgcccaatctaagaattgtaaacaatcgaatgtcgaatgtgtttactctggaagtttactgatccaagcaaaaaagctttaagctataaacatctgtggagtaagaagaatatatagataaatcaatataatgaaatactttggagaatacagtatgatacatgttaaaagatagttttataaaggttgagttataacacttagaagtataaaataaatatgtgccaaagattttatttaacttattaaataatgagagaactagtaagctgttacaccaattcaaacaagaatggaaaggacacagacatatgtcaacagtcatgaagactggaatgaatttataaatagaaaatttgtgcaagatatacaggccaatgagtagttgctcctgatcaggactaaacttatttgcatttctatggacaggaatcattacttacattattattagttttcttcaacttgcaaagttgtaaaatcgtgtaaaacaatgaaaagtacagataactcagaaggatatacaagtcagggcattctagtaatcttagtaatcgtgaagataatttttttttccagacaggagcttgctgtcacccatgtcggagtgcagtggcacaatcacagcttactgcagcctctaccttctaggctcaaacaattatcctgcttcagctgcccaagtagctggggactacaggcacacagcaccatgcccagctaatttttgtattttttgtaaagacagggtttcatcatgttgcccaggctagtctcaaactcctggattcaagcaatccaccctcctcaacctcccaaagtgttagcattacaggcatgagccacagagcctggcctctaagatagtttttatttaccacaaaaaaatgtgtttgatctcattaggtttgggctgattcgttacataactggagcaatttttttttttttttgagactgagtctccttctgtcgccaggctggagcgcagtggcacaatctcagctcactgcaacctccacttcccgggttcaagtgattcctctgcctcagcctcccaagtagtgggattacaggcatgtgccaccacacccagctaatttttgtatttttagtacagacagggtttcaccatgttggccaggatggtttccatctcttgaccttgtgatccggctgcttcggcctcccaaagtgctggattacaggcatgagccaccgcacctggccgcaagattattaattaaccagatatcctccttaagtttgttttacaaataagaagaccacaaaattaatttttgtctggaaattttcttagggaatctcagattctattaggttgttaaaaaagtaattgcggtttttgccattacttaatacttttaaaggtctctatttttgccaacccaagattagtaaactatgcccaagaaacttcaccatcatcatcattttggtaagttcctctcttctccaggtcaccaaaattttattcccacatgtaagtgatcttccttaccacataaaaggctgaaaccttctgctccaggtactaggttggtttctctgggagggcattgtcaccattggcttcaggagtacagccaatatttttttcttcaaagtggtagtgatatttgattagatgaccatcattctcaaatatatctccaggtaaggccttggttgcacaatcagtttgtacaattatatcctgtttaaaaggaagacattcttattaggattgcaaataactatactgtcaagaaaagttaggaaattactaagagtttctgaatttggaggaagtcagaatcaaatattattttgaaatgtttcatattagtttaagaaatcagggtctactaaattgtgtgggttacatatagcttaaaaagaagaaaaagagcttcctcatgtatccagaaaatagaacatttaaaacaaccagtgtcaatactactccaaacaaataggaaaagaaatttccttctgtattcctttttcattctgtgttgattcagtcctgtgataattaattattattcaaataagccttggcttagcagtctgctttcatgaaactttctgcttctggcctgagagagttttagaaattctaactcagtccactgtttaggtccaaaagttgtccaagcagaagtctactcatgagtctattctttcaagtattagtactttgaagtatttggtacaattctttccatgaagcttttgaaactatctctgttgaacacacaaactctggcctatagcttaataagcataatcttcaggtaaacatcaaaatttgttcatagatgacagactattgttaattgtaaccaataatatcaaaatgcaagaggttaaaattctttccactgggggataactatttcaaaagagttttgatcagtatccccttaaactaaaaactcttgcaaatatggtcaaatgatttttgaccagggaaccaagaccattcagtggggaagacagtcttttcaaaaaatggtcctgggaaaactggatattcacatgcaaaagaattaatttgaacttttatctaacaccatatacaaaaattaattcaaaatggatcagagacctaaagctaagacccacaatacaactcttggagtcaaaactttatgacattggatttggcagtgattttcttggacatgacaccaaaggcactggcaacaacagcaaaaagtacacaaattagactgcatgggaattttaaatctttgcacatccaaagattctatgaacagagaaaaaggcagtccacagaatgggagaaaatatttgcaaattatatacctgataagagattaatatccagaatatacagagaactcctaaaactcaacagaaaaacaacctgattcaaaaatgagcaaagattgttgtagaaaaaaaacaggttcttgtcacaagaccagaataatttaggcatgtggacacattgtagggtgagtagggcaggatttattggatgaaaaggaaaaaaaaagggaaattggaactcctggcaaagcaagagagaatcctgctagcaggtttcctgcctcacagatttaattgcaggccaccccacacgcaagctgaagaccccaggctcctcccctctgcaaatggtgtgggattccaaacttcccgtaactccaccccatcctccccgtgccagtcagagattctccagggatcctctgccttatctgcctcctgcatctatcattccccctctgaagacatacatttaactgccgttaaaataaggataaggatgaataccaatcttaactgcttcctgctggtaaggggcactgttttggtaaacagcagtcacatctccttcagaggcctatctaagggtccccaacaaaagggaccatcggccaagcctccagttgcatgaccgtttggaggttgatggcctgaaggtgacaagagagaaaccaggttattagaaaacttgtatcaaaatgaaacaaggggcaggtgaggacagctcaaaaatctcgtgtcctttgaccagtctgtacagggagaagggggaccaaaagcttgaccggtaagaaaaacttttacccttttgctagcatttcagacttctgggttcctgtcccctgagctcaatcctaagccaatcagtttaaggtttgggaaattaactcttctcagtttggaagatgtatccaaagggagtgtcccatagtatggagacacagttacctatctgtgaagagaggacagggaaggaaaaaggaaaaaaaaaaaagaaggcgttttgttgttgttttttttcagaggagtcccagtggttcaggatgcaattgaaagggatacagactgaagattaatgactactcatgtagaaagaggggagcaggtgtccctggttcctttttcttcctagcatatacccgaggtatgtgagggagggaaagtgaggtgttcctctttctttcctccatccttgtatcccagtgactgcaacagggtgccacccataggttttaaagtggctttcacccatgttaacagggggagctaaggggtgggaggtatcagcttttaaccacatatgccctatctccactgctgtcagtagccttgaattccccagaccccatttatgcgatggatactagcataacctttattcatgaaacaagaagcttggcttaactggcaggaatcagtcatgctcacctgcattgtgccttttaacttccattaccgtctgcctctggattcctcagatctagtgttctttcctagggcgttgacccatagcttggagttgagtttgagacaaaaatgtgtcttggggtggggaggagttgcatggactccttatcataagctgaatgctaaggtgaagctgtggaattgagtcctcctccaacaagggagagaaaaggatgtctcatgacatgcccaaataactgttggctatattcatgcttgctaagatttgggtgcatggtgcttggctttggttagctcccttggtcttactttcccaaaaaggaaacctggatgggcatcctatttattgccatcacctggcaggatttgcaggttaattgctcagaactagaatattgatccagatttctacatcacctgtcccttttgttctttctgagctacagctggagattgctggaacatgcagggttagtctaaaatgtaggttacaacttaaaaacaactaggagtttagaatgtaatgacaaatgtataaattgtgaaacataatttctctctctccagtccttattttcattaaaaaaaaaatcatgataggactgagttgtttgcaaaatagacttagtcttatatttagcctgattatttgcataaagtacagcaagaataactatttgtaaataggccttttagactggctttgatggaactctattccacaaggaatctcagataagaccttttaaagtgaagcccagccatgggtttgtagcctcaaatacctgtgagttaggtgatcctctcctcttaaggtcccaggataaacttggagatcctgggcctgttagaaagagacattctttactgaccacagatcaggaaccctatacagggactgggtagacaagggtatgaggccagttttctcaattggcttttatgagctctgcaagtcaagcttgactcctgaaagggaaacacacccttccagtcaaagccttggtaaaaaaaaaaaaaacttgtttctccaattgcatcctgttgcaaaagaaaatggacttttattgcactgatccaaacaactatattgccagaagttaagaatactcacagatactttccaaattctagagaaaccaggcagagagaaacacacgttctccaaattttgttcacagtataccttacttgattattaagggctgtaaatagttcaaaatcagtttccatgaatctgaaaaataaaacaaggatcagcaatattccaaaaaactcaaaaagattgcttcagttttctgcatttagtccatttagttaagtctttgtgttgttgtttacttgtttgttttgagacagagttttgctcttctcacccaagctggagtgcaatggcatgatcttggctcactgcaacctccacctcccaagttcaagtgattctcccgcctcagcctcccaagtacctgagattacaggtgcctgccaccacacccagctaatttttgtatttttagtagagacagtgtttcagcaggttggccaggctggtctcaaactccatacctcaggtgatccacacacctcagcttcccaaagtgctgggattacaggcgtgagccaccacgcctggccccatttagttaacttttgtgttgcttaatattgatgaacattttatttctttatgagtcctgtacgtttttcctttattccaatgtcactatctccaaagttattagaaacctgcatttgagagcacctgttagagtcctataggtgattataaaccatcttttgaaaaggatcaaaacaaaacaaaaattgtctgaataacaaaatgtccagggtagttacagttagaatcaccattgacagagaagtttggttatctttgtggtttataataacttgacataacaaccttaattatgattgatagcatatactttagacattagaatttttgaaatttcctacaattttgggacatatattagtattattccccaaaatatatcctaaagtagattaaacaccgtttggcaatcccatgtaactaaatatgccaaataatcctgtttacttcttttctagatgccccaggggacctctgtagcactcaaaaagccaggtatcaggaaaaacaattttgaaactgaagtttgattttgggaagcctattaaatatattagaggtttaaaacaactattgttatgaaatagaattccagattaccatgaattatttattttgccaaaatgatgactcagatactttaaaaaagcaaaaacttattatgaccctttacaaattttgcaaaagagcagattagtgccttaagagtatcttgtgctttcatttcaatgctcagttcactgaaaaaccatataatacctttttgaatttagtcaatatgtttacacatggaatttttttcaagatttttacagtccttctaccacttgtttgaactttgagctttattttatctaattcaaaacaaccctttaacactaggcaagaatttacatttttatgccttttttataatcttttactaaaaacacatcttattagtcttacatgcctcacatgtaaatttatttccagtagtttgagttatatgttataatggtaactccttgaaattttttactttaatgtaaaacctgataagttgttttcattatgtgctaggtgctgccaaggcttaactccttccagcttaattaaagatgcggttagtactacatgtccctagccttaccatttatggagcaggcaagtcaaatagttctttaaacccaaaaagcagtttataaacttaaaacatttagcaaacctagcacctgacctgcatagtttagtccacctgtttatattttaatgacatctgctttttaccaatattctttaagggttgtttttatttctcaaagattaaagtcacatgaactgaaaggcaccacaacttttatcatccctttaaaaatttttttgatccaagcactatcttcctttaagccagttaattagagctctttttataggcatcacacacacaacacatatataactaaacagacaggcaaaagaaaacccagtcaccataagatcttttgcttaccaatctcctaattggattattggatatagccctttaagagacagggctaggaaaacatgcagcttctaaaacctaataaacaggcatagatggggcaaaaacagattttcagagggatctatccacttttaattcttggggttccatgaagaaaatagaggtctttccccttcatgtgtgcattgagggtggcaagacaaacggagaaaaataattcagtcaactgagaaaaaaaccctttttccagaaaaacaagatccaagaaaagaaaaacataaaggccatttaaatatacctataatttgaatatccacttttaattaagccgagcactctttttaagaatttccttttaactcccttactacccgactttagcgatgccaagtggccaatatttctggctttcaaactttactaaagactcagagaaaggaaaatccaaggcggttcatggaggggaagagaatcaataattagcaaaggtcacacaaatatcaaactggaaaggactcattgaatcccaggccaccattgtaaaatggcagaggctagaacaaaacattgccacatggttacaggctttgctcccaaggacataaaacaagatggaggcctgcagcaaagtttgctactgaccatatggaaagtcatgcaaatcacaccagattggttacagcttaaggccaaaataacaaatcctttttcacaagtaaaactctacagagaatataaacagtgatccccattattcctggtccagcaaaatctcttccaaaaggaaaaaaagaaaaacaaaccctcacttaaaaataaattcctgaccctgtggagaaaaggaaaagacagcttaaatgcagggctgtattaactgctaatagggtggagaaaagaaaaagatgcctggggaagaacttcgtattcttatgcaaataagttcttccaccagtgagaaaaacttaatcactttcccacagagtgaaacccctttccctggggaggggaaggctccacagatgcaatgcagagagcattggccagcctgccattaggcacccttgggccatgcatcccagccctggcagggagaggagtgcaggagctgccattctgtggtccatcttgcgcatgcctgcagctgttgggatgaggtggtgcacagtttcctctaccctccaaagaggtctgaggagaaagagacatagaagtgaaaggaaaaaagatttttagacttgcttggtacttaccttttctcaagccccatgttgggcgccaaaaatgttgtagaaaaaaaacacgttcttgttacacaacagggataatttagttgcatggacacattataggatgagtagaacgggatttattgtgtgaaaaaaaaagggaaacaggaaacctcagcaaagtgagagagattcctgctagcaggtttcccgcctcacagattgaattgcaggccaccacacatgcgagctgaagagcccaggctcctccccactgcaaatggtgcgaacttctaaacttcccatagctccaccccatcctcccagtgtgcaggccagttggagattctccagggaacctccaccttatctacctcctgcatctatcagtatgaggatacaaaggcataagaattatacagtggactttggggactgggggaagaaagtgtgggagggggttgagtgataaaagactacacactgtgtacaatgtacactgctcaggtgatgggtacaccggaatctcagaaatcactactaaagaaagtattcatgtaatcaaacaccacctgcttcccccaaaaaacctattgaaattaaaaataaataaataaaaacaaaagtgagcaaaagattcgaatagacatttctcaaagaagatttgtaaacggcaaatcttgaataccacagttttaaaaaggtaaaagaaagcagtgtggacagggagagcattaacagttctctggggactttatacaaagcatacaatttttaatatgtttacattaataaaattttccctatagacatataacctagggaagactgggcttctcttttgatattgtaactctttatctgtgcttaaagaacaaacttttgtgatttctattggctttctgggaaatgtcaaagatagttttatttctttttctttttttctgggcctgtggactttgtagataagtacaaaatagttttacattccctgaaatttttttttaatttattttatgtttgggatcaaattttgagttatcagaggaaacttagacatgtaatttaaataggaccatggatacttgagaaataatttttgattgtctaatcaaaatgataatgaaatattttttttaaaagcatgaaaggtaatacagttgttaagaagtgaggaacttttgttctttggggttttttccttaaatacccaaatacgtaataaagttaacatataggagagaaaattaatctggtaagacacagaatctctgctatctaggcagatgatgtagatcctaggtaaaggcattaatcaccaaaccagccaagaaagccatcaaaattaagtgaactttgttgatatgttaacacatttattttttctttttttgacacagagtctcactctttttgcccaggctggagtgcaggacacaatctcggctcgctgcaaactccacctccggggttcaagtgattctcctgcctcagcctcctgagtagctgggattacaagcacgcactaccacacctggcagatttttgtattattagtagagacggggtttcatatgttggccaggctggtctcgaactcctgacctcatgatctgaccacctgggcctcccaaagtgctcggattacagacgtgagccactgtgcccagctgagaaaatatattcttaagtgaaccagttttataagtatattataactgttagtattttcatagataaaaaactagtctgctactctaaatgccattttaagaaatcctgtgagacttattggtgactcttctagattcacttggcattataaattcccagggaacaacttggtctaatcaactatcatctatcatctttcaccttaattatttcagtggctggtctcatcatttccacccttgcctcccttcaattcagtcttcaacccatagccagagtcgactttttaaaataaagtaaataatgtcacttctctacttgaacccttcaatggattcttatcacattcattgttaccaaaactccttgacatgttctgctaaattctgtataatctggctcctccctgatttctaggctcttctcttaccatttctctcttgtgctttattgcttactaagctccatatagctttttctttcctcagggaatttgctgtccccattacttaaaatgttcttaaacctactctttacctggctaactcctgtgcattctttctgttctggtttatctctttctcacagaaggaattctgtgatccacactgcccacctaaattatgcctgcagttattctctatcattgcaccttgttattttcctttatagcacttatagttacaattatatacttattcatgtgtttacttaatttatctctagaactgtaggtgggaagatccatgaggacatgagtcacatctcttttattcatatggtctatccagcacctagcacaggttggcacatagtatggactatataaattttggtaaatatatcccatgaaaacatatgatgcatcattcgtcttgatggaatcaatgtctattaattaaattcttaagactgacattttaaaaagggatatatttcgccatacccatgatgtataagaattgttccatggccaggcacagtggcttacacctgtaatctcagccactcgggaggctgaggtggagggattgcttgaggccaagagttcaagaccagcctgggcaacatagtgaaaccctgtctctacaaaaagtaaatttagctggatgtggtggtgtgcacctgttgtcctagctatttgggaggctgaggtgggagaattgtgtgagcccaggagtttgagactacagtgagctgtgatcacaccaatggatctccaatctggatgacagagcaaggcctatctcacagaaaggaaaaaagaaactttcatgaaatagacaagtagtcaccatattctgttcctatattaagtaaatatattaaatgaatataataatgataatagagaatcatttttgaatgctaaccataaaacattcttctatgcattttataagtgccataagaaattaatactggcatgcagatttcagcaagagtatacctttttgttttcctaaaaggcaattacacgggaaaccaaataataataaggatggattactaccattgagagcaacaaaaattctgaaatttttaaagcaatgagagaataactttagtaagtataaatattccttgtaaaaaaaaacaagcttatatgaatatttaaatttttaagtttataaaaaagatctcttgatagtcatacttcatatgtttgccatctaagtggtttttcattataaatatgaatcatgaatttttgtagatttttgtattatgaatttttatctaaatttaggtattcacattttttgttaaatttcattttgttggattcagcccatcagtctactaagaggtctttttaaaatttatatcagctgtctagtatattacttgtcttttgtagtttctgtcaccagcaaatatgttaagcatgctttcattcaagtcactgataaaacttttttttaggctaggccatttcacatactaccagaaaccctgctggttgtaattgcttaactagcatatttctatttcaacacatcaaaacctacagacctactttctctatcgacaaggcatttatgcgtgacttatcaaataccttaatgaactcaagatacattgcattgacaagttttgggaggttgtttgtttgtttagatggggtctcactctattgctcaggcaggagtgcaacagcacagtcactgtatcctccacctcctgggctcaagcaatcctcccgcctcagcctcctaagtagctgggagcacagggacagttttttctttaataaaactttgtaacatttaattataacctctgaaggatcagtattagaagctctgagaagacatgtgatatatattttctgatataacccatttaggtattatatgtaatcaatcttttttgttcttgtttttgtttttctttctaagacagagtttttctctctggctcaggctggagtgcagtggcacaatctcacctcacgcaactttcacctcctgggttcaagcgattctcttgcctcagcctcccaagtagttgggattacaggcacatgcaatcacacgcagctgatttttgtatttttagtagagacagggtctcaccatgttagccaggctggtctcgaactggctggtctcaaactcctgacctcatgatctgcctgccttgacctcccaaagtactgggattataggtatgagtcactgcacccagcctgtaatcaatcattattgttagttcaggtgctgtatcacacacctggatctcaaataggatttatagaaaatgcagcctaccttaatgatctctaaaaagagaagttggaaagaaagggtgcacattttggacttggccaccaagctggtcaagggatccaaaaacctccaccatagagactgataaattgtagctattgaagctgtacttctttgtacataggtgctttgggagactcactctgattattgtaaatttgctcactagctacccaacattaaattcaaataacagagaatttctattgtacagccttgcaactttgctttaagtttaaacttttctttaaaataaaattttaagtggcaaaaataattattagaagagaaaatgtgtgctcatttttgaatattcttggcatcaaatataaatttgtatgtttactttattggcattcatactgccatttcaaaggactgcagcattcaaaaggggaaacaatattttgactgtgtattctgatttttataatgtaactctccatttcttcttttaaaagtgcctgcccaaccagtgaaattagctttaggacaggaaaaaaaaaaaaaaaaaaaaaaaaagcatagataaagaatcagcacagttcctaggaaaattatgtgttcccattacagttttccttaatgaggaaaattctgttatttaataattcacagtcaaaattacattgcatatctaaagaaagtttgagattatctgggacaaattgtttcctccatgctatgagttgcataagatagtagaaatagattacttctctaaaagtaggaatgttatttcttttgtgatttggcatttttccttctcatttgttctgatttaactcactacaaattctacttgctcaaggtagatcctcactactccatggcaagcctttggttcatctctcttactgacaaccttatatacattgccaaattgcaattttcagacctttgctcttgactcaatttcccctattttctcctcttcttattatattaaaggccatcagagctaaattatttgttctttctatttaaaacaattttcctgaattaatactttgctctattccttctatctcaaagaactgcttgtaattctcagttagtggctgcttctacttccttattattagatatcatctatgtacgagacactgtattcattccttgtttctccctagttgttgagtatgttggccacttattttctgaaacagtcccccaccatgttttcattactgaaatgttttaattaggcaagaacacatgagcacacactcactaaaaaaagaaaatgaaacatagataagattaatatcctttttgaaccaccctctcattcatttttatttaccctcacactcccccaaaagtaaacatttttatcattttgaagggtatccttcaaaagttttctgtacttttctgtaaaaacataggaaataaaatcctaaggtttttgtttgtttgtttgttgttgttttgtttgttttgagacggagtttcactcttgttgcccaggctagagtgcagtggcacagtcttggctaactgcaacctccccctctcaggatcaagcgattctcctgcctcagcctactgagtagctggcattacaggcacctgccaccatgcccagctaattttttgtatttttagtagaaacgggatttcatcatgttggtcaggctggtctcgaattcctgacctcaggtgatccacccacctcggcctcccaaagtacagtttttaagtggtgtgcgtgtgtttaattaagaaagggataaagggccaggcacagtggctaacacctgtaaacccagcactttgggggccgaggcaggcagatcacaaggtcaggacatcaagaccatcctggccaacatggtgaaaccccgtctctactaaaatacaaaaattagctgggcatggtggtgcatgcctgtagtcccagctactcagaagactgaagcaggggaatcacttgaacctggaaggcggaagttgcagtaagccaagatcgcaccactgcactccagcctggcaacagaacaaaacttcatctcaaaaaaaaaaaaaaaaaggaagggataaagaaacttgcaagctgcttctaaaatttatatagatagaattgcaaagggcaaaaaaacaaccaaaatagtgttgaacaagaaaaagatcaaagtgggaagacctgctctaccaaatatcaagatttagtataatgatacgattaaagtaacttcttaatggtgccagaattaatatttagaccaatggaacagaatttaaagcccaaaacacaccaacacacatatggtcacttattgtatgataatttatagtgcagaattatagagaagttattttttcaataaatgatgctgggacaacaggctatttatatgaaaataaatgaaattggaccccctatctcacagtatacaaaaatcaactccaggtgtattagagatccaaacaggaaggaggaaactataaagcttttatagatttttacagaacaatgtttttattatgctggattaagaaaggatttcttttttaattgaattgaagtaaaattcacataacataaaattcaccattctaatcattttaaagtgtgtgattcagtgacttttactacattcacagtgttgtacaactattttatccaattccagaaaattttatcaccaccgctcccaaaaaaacaccttactcattaaacagtctattctccattccctctgcccccagcccctgacaaccattaattggctgtctctgtaggtttacttattttggacataacatataaatgcaatcatacaatatgtaactctttatgtctagcttctatcactaaataaacaacattttcaaggttatccatgttgtagcatgtatcagtactcctttttatggctgcacaatattccattgtaaggtatactgcatttagtttatccatttattagctgatggtcatttgggttgtgtgtactttttgattattaaaataatggtgttatgcacattcatgtatgtttttatttgaacacctgttttcagttctcttgaatatacacctaggagtggaatttgttgtaatatgataattctatgttaacttttaaggaagtgccaaactattatccatagagctgcatcattttacatacccaacagcaatgtatgagggttccagtttctctatatccctgccagcatttgctttttttcttcttttttgcttttgagacagagtctcgcactatcgcccaggctggtgtgcagtggcccaatctcggctcactgcaacctcagcctcccgggttcaagtgattctcctgcctcagcctctcaagtagctaggattacaggtgcccggcaccacgcctgactaattttttgtatttttagtagagaaggggtttcactatgtttgccaggccggtctcaaactcctgacctcatgatcttccagcctcggccccctaaagtgctgggattacaggtgtgagccactgcaccgggccttctttttttcttaattcttatcatctgaatgggtgtgaaatggcatctcattgtggttttgatttgcatttccctaatgactaaggatgctgaacatctcttcatatacttgttgatgatttgtgtagcttctttggaaaaatgtttattcacaccttttgcccattttcaagcgggttgttggtctttttattattcagttgttagagttctttacatattatctggatgctggactctatcagagatatgatttgcaaatatttcctccctttctgtattttgtcttttcactgtcttgataatgtcctttgcacaaaagtttttaagtttaatgaagtccagttaatctaatttttctgttgttgcttgtacttttggtgtcatatctaaaaatccatcaccaaagtcgtgaagatttacctttatgttttcttcttagaatttgatagttgagctcttataatacaattaggtatttgatccattttgacttaatttttgtgtatggtgtaaggcaaggcttcaacttcattcttttgcatatggatatgcagttgttctagcataatttattgaaagaatgtcctttccagttaattgccttggcactcttgtctcaaatcaattaagtataaagttaggagtgcttatttctggaccctcaattctattccattaacctatgtttgccttatcccagtaccacactgttttgattacatagctttgaagtaagtttagaaagcaggaattagcctgacacggtggctcacacctgtaatcccagtattttgggaggccgaggtgggcagatcacttgaggtcaggcgtttgagaccactctggccaaaatggtgaaaccccgtccctactaaaaatacaaaaaaattagctgggcatagtggtgggtgcctgtaatcccagctacttgggaggctgagacaggagaatcacttgaacccaggaggcggaggttgcagtgagccaagacggtgcgattgcacgcgagcctgggcaacaagagcaaaactcggtctcaaaaaaaaaaaaaaaaaggaagaaagcaggaattatgaatcctctaactttctttgtctttttcaagattgttttagctattaggttccttgagattccatatgaatttcaggataggtttttctgtttctgcaaaacacaccagtgggatttgacagtgattgcattgaatctgtagatagctttgggcagtattaccatcttaacaatattaagtattgcattccattaacacatatgtctttctatttatttgcctttaatttctttcagcaatgttttgtaatttttgatatacaggttttataatttcttggttaaatttactctgcatattttattctctttgatgctattgtaaatggacttgttttcttaattttatttttgaacatttcagtattggtatatagaaatacaactgatttttgtgtgttcttcatgtattctacaacttcgctaaatttgtttattagctctacttgttctttttgtggatgtttcaggaatatgtatatatataaaaccatgtcatctgtgaatatagttctacgtcctttccaatttgaagccttttatttctatttcttgccgaatttccctggctagaactttgagtacaatgttaagtagaattggcctgagtagacatcctttttcctgaatttaggggaagttttcagtctcattattaaggaggatgttagctgtgggttttgtctagatgcctctatcaaattcaggaagttgccttatattcctagttttccaagtgttttatcctgaaagcatattgcatcaaatgtttgttctacattaacggagatgatcatttgtgaagtttttttccccttcattctgttaacatggtgtatttcactgacttcttatcttatggtgagccactcttacatttttggaataaatctcatttggtcttgatgtataattgttttagtataatatttgttgtttcctagtattttgttaaggatacttgcatctatatttataaaggatattagcctgtagtttttttgttcttatgatgtcattgtctttagtgtcagggtaatactggccacttaaaatgagctaggaaatgttccctcctcatattttgtagaagagttggtaaataatttttgttaattcttctataaacatttaatagaattccctagtgaggccatctggtcctgggcttttccttgttgaaagtatttttatgtactgattcaacctttttagtggttctattcagattttctatttcttcttgagttggttttggtagtgtctgtgtttctaaatatttatctgttttatctaggtcatgcaacttgttggcatacagttgttcctagtatttaattattatgaaataatcatctggtagtcatttcatttcggtaagctcaacagcaatgttcctactttcattcctgattttagtaatttgaatctttttctctttttgtcagcctacttaaagatttgttcgttttgttattacttttatttttttattatactttaagttctagggtacatgtgcacaacatgcaggtttgttacatatgtatacatgtgccatgttggtgtgctgcacccattaactcgtcatttacattaggtatatatatctcctaatgctatccctcccccctcctcccaccccacgacaggccatggtatgtgatgttccccttcctgtgtccaagtgttctcattgttcagttcccacctatgagtgagaacatgcggtgtttggatttttgtccctgcaatagtttgctgagaatgatggtttccatcttcatccatgtccctacaaaggacatgaactcatcctttttttatggctgcatagtattccatggtgtatatgtgccacattttcttaatccagtctatcattgatggacatttgggttggttccaagtctttgctattgtgaatagtgccacagtaattttgttgatacttttaaaggaccaactttgattttgttgattctttcaatgtttttgtgttctctatttcatttatctccactataattcttattattttcttttgtttgctttgggtttagtttatactttattttatagtttcttagggtggaagattagtgtattgatatgaaatctttcttctttttaaaagtagatgtttacagctataagtttccctctgaacactgtttctctgcatcacttgaattttcatatgttatgttttcatttttatttgtctcaaattattttcttatttcctttatgattttctctttcaccattggttatttaaaaatgtgtttatagcagcatgatttatagtcctttgggtatacacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgttttttggctgcataaatgtcttcttttgagaagtgtctgttcatgacctttgcccactttttgatggggttgtttgttttttagaaaatgtggcacatatacaccatggaatactatgcagccataaaaaatgatgagttcatgtcctttgtagggatatggatgaaattggaaatcatcattctcagtaaactatcgcaagaacaaaaaaccaaacaccgcatattctcactcataggtgggaattgaacaatgagatcacatggacacaggaaggggaatatcacactctggggactgttgtggggtggggggaggggggagggatagcactgggagatatacctaatgctagatgacgagatagagggtgcagcgcaccagcatggcacatgtatacatatgtaactaacctgcacaatgtgcacatgtaccctaaaacttaaagtataataataataaaaaaaaaagaaaaaaaaagtgtttaatttccacatacttgtaaatttctcaaatttctttctttcttttttttttttttttttttttttttgagatggggtctcgctctgtctcctaggctgaagtgcagtggcacaatctcggctcactgaaacctccacctcctgagttcaagcaattctcctacctcagcctcccaggtagctgggattacaggcgtgtgtcaccacacccagttaatttttgtatttttagtagagatggggttttgccgtgttgaccaggctggtcttgagcagctgacctcaggtgatccacccacctcggcctcccaaattgttgggattacaggcatgagccaccgcacctggtcccaaatttctttctgttactgatttttaatttccttccattatggtcagaaaaaatacactgtaaggtttcaatctttttaaattttgtgagacctattttgtggcctaatatatatggtatatcctcatgttcacttcagaaaaatgtgtattctgctggtatcagatacagtgttcctatatggctgctaggtctagttggtttatagtgttgttcaggtcttctattgaaggggtccccaagccccaggccaaggactgataccagtccatgacctgttaggaagcggtccgcacagtgggaggtgagcagcagcgggcaagcaagcattactgctgagctctacctcctctcagatcagtggcaacattagattctcataggagcatgaatgcaagggatctaagttgtgtgctccttatgagaatttaactaatccctgatgatctgaggtggaacagttttatccaaaccatccccaccaacccccagtccgtagaaaaattgtcttccataaaaacactccttggtgcccaaaacattgaggaccgctgttctattgtacttgttgatctaactagttattctaactattattaaaagtggaatattgcagtctccaactcttatttttgaagtttttctctcttcattattatcagtttttgctttatgtatttttttaataattgttatgtcttcttgattaactgacctttttatcattatataatgtcttttttgtctcttataacagttttggcttcaaagttgattttgtctgatattactgtagcttctctagctgtcttttggctacagctcccatagaatatctttttccattccttcaccttcaatttatttgcgtctttggatctaatttgaatctcttgtagatagcatagacaatcatactccacttaacaacagagatatgttctgagaaatgcattgttcagtgattttgtttttatgcaaatgtcacagagtgagtataattacacaaacctagatggtataaccaactacacacctaagccaaatggtatagcctgttgttcctagtcctaggctgcaaacctgtacagcatgttactgtaatgaatactgtaagcaactgtaacataatggtaagtatttgtgttttgaaacatatctaaacatagaaaaggtaccagaaaaatatagtattataatattatgggaccactgttgtatgtgtcatctgttgtctatcaaaatgccattatgcaatgcatgattctagttggattatagtatttttaattcattctgccagtttccatctttgaattggatagtttatgtacatttaatgcaattactataaagaagggtttcttccattttgctatttttatataatatcatttttgttttttatctcctctattacttccttttttctgtatagatattttctggtgtaccattttgattctccttgctacttttactaactattatttagttattgtgttagtggtttccctgggaattacaattaacatcttagctcataacaatgtagtttgaattaataccaacttagtttcaatattatacaacaacttcataccttgtccactacttacgttattattttcataaattacctatcaatatattgtatgcctgtcaacatagatctataatcattgctttatgtagtttttttaattatatggggcagaaaagaggattcacaaacaaaaatatacgtgagatacgactgacctttgtgtttacctatgtagagttctgtatttcttcatgtcagaggattcacaaacaaaaatatacgtgagatactgacctttgtgtttacctatgtagagttctgtatttcttcatgtcagtcacaattactatctagtttctttttatttcagcctgaagacctccctttagaatttttttgtagggcagatttatgagcaatgaactcactcagtttttgtttatctgggaatattgtaatttttcttcgtttttgaagtttagttttatcagatatagaattattggttgacagatttttcatctttcaacattttgaccatatcattccactgctttctgactgtcatggtttcttttgaaaatcagctgtaaatcttattgaggatcagaattctctcttcatctttgtcactttcaacaatttgattataatgtatcttcgtgtcagtcttttttagtttatcctgcttgggattgttgaacttcttgtgtgcattcatgtctttcatcaaatttgggaagtttttaggcattgtttcctcaaataatctctttgcttctttctctcctctccttctgggaccaccattaatcatatctcagtgtgtttgatggtattccacaggttgcttaagccatgttgttattttcctttatttaagccatgttgttattttcctttattttttttctttctgatcctcagactagataatgttaatcaccttattttcagctcacatctgctgttgagtcccactagtgaatttttcatttccgttgtaattttcggtgttagaatttgtatttggtttctttttatgatatttgtctttttattgagattcccagttggtgaggcatcattcttgttcttgcctttagttctttgtttatagtttcctttagctctttcagctaaactttattaaaataattaatttaaaatctttgtctagtcagctcagtgtctgagctttctcagagacagtttccgttcatttcttttttcttttctttttttttttccctgtgtacaggttatactttcttatttctttgcatgcttcataattttttgttgaaaacttgacatttaaatattataagtggcaactctggaaattagattctcccctctccctggggctttttgttgctgctttttcagcagtagtagttatttgtttgttattcattttttgaaatacttttttcaagcttgtatttctttgttgtgcataacctctgatgtttctgttgtttgcttagtggtcagctagtgatttgacaggtatttccttaaatacctagaaccaaaaaattaataataaaaacaaaacaaacaaatcagagaaaatctcccagtttttgcagatgagctctttgtatatgttaggtcacacttcaacactcagccaggcaatttacagctcttcattagttttcacttcctgctggtatagagtctcaaatttatccacaagtgagagaatagaaccttctcaggtcttttctgagggtgtgcccagccctgggcataaacctgaccttttagagtccaaaggatacatgggagcttttcagagtccttatgccttaaagtacctcattccataaccctcactcccaggtttttcactttatctattgtttgtcctgtttttccatgcccagatgacagtggctaatacatttgcctttaaatatttgaacaaacattacccaatgaatagctgcctcaaccctgggaatattctgagttaagtgaaataaaggcaggccctttgagtgtgtccttcaataagccataagatatttcaacacaaaaaaaccacaattctttcagaataaggtttgttttccttctggtactacagacctgtattggaaatgtggactgttgtcttcaaggccaccttttttgtctatttttcttgattacccatttacctggttgtaaacattttattcattttcagagttctggtaaagtttattctgcctgtttttgccaatttattttctgctttagtagagtgatggaattttggatttctctactctgctgttttcactgatgtcacccaggaaggattccttttaagacacaaaaaccactaaccataaaggaaaatattgatatatttagcaacattaaaattaaaagatttcgttcatcaatagacatgataaagtaaggtaaaagacaagctacagagtaggaatagatattcacactagatacaactgctaaaagactagttatccagaataaatactaaaatctaacaatttaataagaaaagaacaaccaaataagggaaaaaatgggcaaggatttgaacggggacttcacgagaaaaaatctaaatgactgaggaatgtatgaaaaagtgctcactctcactaagaatcagagaaagggaaaataaaaccataatgcaatattgttacacaccaaccaaatttttttaaatgaataataccaacaatgctgggtggaactgagttgtagaataagagaaactgttactattctttgtggacagatgtatagattggcttaaccaacttagaaattttttaaagaaggtattcataccctataaccaaccattctatccctgaatgtgtatatatatatatatatatatatatatatatatatatatatatatatacacatatctcccagaaatttactcacatgggtatcataacacccatgggttcacagtggcatttttcataatgtcctcaaaatgaaaacaatgcagttgtctatcaacagagtaatctatattcactgactccttttccttacctccagtttttttcttgaccccttgtaatcaggttctgtcttcatcaaataatgaaattttctttcaggtaactaattactaccatcctgttcttcataatctaattcttcaccctttttctagtatctgtgttgacatattcttctatgttcttcatctttagaatctcatttatttctgtaacttcaacaactgtatatctgcaataatttctaagtctgtatctccagcataggcagtttttgtttttttttttaagattggggcaaagatttgttctagactatgtaatgaaattgtaaatttatgtttactgatattaactggatccacaatggtaattgaaaattcttttgccttacccatcattttcattcatcaatgcattttttgagaattttaccactctcctaaagtcatctttatcacttttacttccccttattctcatcaataaggcctctcctgcaagcaccaaaaaaatagtagtaataaatatctgtgtcttttacccacaatttactttgctttatcatgcctactcaattcctccatttgtatctactctttttacttaactggtaatttctttaataactggatgtaatggcttcttttcagctctctctctctattcctattctctcccatatttgcttttttttaatcttgcaactttcttcttttttccattgccttgatactcacccatctcgatttgcctcttttttctctaataatttcttatgataagaacaccaaataatttatcttccaaaccagaatgcttttgaaaatgaaaagaggtgctgtttgataattaagccagcataataggtataatcctagattgttcaaggaaaaatcagatgtatggttaccccatacatccttatcttagagatcttatctcccttcagtttgttttcttttgttaacttttaatatgaatgttacctcaaattgtcagccatcgtcttttgttctttcacatattctctgcaggtgatctgacacatttgaatgactcaaattactacctccattgataattcccaaattatatgtcctaactttttcctgagttccagactcatatacctcatcaaatagctccagattagtagcccgaaagtacctagccacaaaatttaaacttatcttctctctcgagtatcctgatttttaatttacattgaggcatatatacacacagagatatgtagtgtatatatgcagttatgtgtataagtctggagatatatatcacacacacagagacattattcgtgcagttgcttcattagatattggacataaaatagtagcaaaacagttccatcatgacagtgcattctcatatgggagacagacattgatcaaagtatcacacgtataaatgttgtgatactttctgtaagtatggtcattgctatgaaggagagggatgtgatgtcatatgaagtataaaatgggtatttgaccttcttttaaatacatggcctttttaattggataagtggcaacaaatagctcttcaaaattagactttatttcttggaaatatttatgacaattcagtactcaaatatgttagcaaatggagtcgtcttgcttctcaaaattcctactgcttttcatactatttatgactatattgtttataaaccatataaaatttcaaacactgaaatggtggcaatatctttggaattaaggatgttggtatagaaactaaataaaggagcttctatagaaatagcattagttttgtgaggcagaaatgatgcataatattaggaataccttgtagtcacaaagtctggctgtttcttcttttcacatagtaagtgatatttgttgattaaatgttaattgcttgtctttttatcatatgtttcaagtcttgcgtgcaaaatttgaaagtcctcatgttcccattcttagaagacgtatgcccgttactggtagcccagaacatgaactaaattatgcaaggcctaaagtaataaatttataatcaacatatattaataatgttaaaaataatctacagtattagtctttatgtttgtatatttttagaataatgataattacattagtctttactatgttgataagtataataataacagtaataataaccaacacattaaatatttaccacttgaaagtgctaaataatctacacacattattttacttaacccttgcagtattccagtgaagcagattctattgttgtcctcaattttcagataaaggaagtagcaattcaaaaggtatatccatcaggatcctagcagacgtcagatagcatgcttaaataggtaattgaggagagttcaataagaacctataggatgtacaaaggtttggacagaatttagggaaaaccacaagacatcatggaatgcctgggattagtaacagtgggaaccattaatgcttctacctaatggggcaaagggaaggagtgctattagaatctagagaaagagctataagccagaagggcagtctgacatgagctatgatcttgagttgagtgacacagccaacctttgatgatctggtagagagggagctaggagaataaatgccagatcttaccctatcccaactcagtcttctgccagtgcctttcactgactgaacccagctggaagccagggcagaaaataatttgttgatggtgtgcatacaggtcagcttagagaagagagggtgaaaatggttggagactgatctgaaaaggaaatggaaaatatataggaattaaatagcttgctcaagatttcaaactattaaatggcatagcaagtatatgaatgaccaatcctttattcctaaccacaatactatactgcctctcatattaaaaagttttatgaaatggtacttgccagggaaaatactttaaatctgaaagtttctattctatctcaagttgttggatgcatttatacctaacagtaagtgacaccaaatatgtcagagctgagcagcaaagaatgctaaaacaaagggggtcttgattctacatgttattgacattttcagaatattaaaccatagttgttccccttgttcagattccagactccatcatttctcgtggtgttcaggtgctcccacgagacacagcctccctcagcactactccttcagaatcgcctcgtgctcaggctacatctcgcctctctacagcttcctgcccaacaccaaaagtaagtatggttccttcgcatcttacacctgctcttctatagtaatctgggaaaactaaccaatatttcctcctgcttgtcaaggttggattgcatgcaagattacactgtgaaaaatgaataaagtgtaagatagttcccacccattgtgtcacaaattgtcatattaggccactagtaggacaatacagatttcattcaaaatgtcttactcctacatcatagctaagggtattactttctgtagctcctgtttctttgttgtagatttgttattttttagtatacttaacattatagatgtaaagttatttgtttatgccgaggataaatgtacttttggccagtaaacagcaagattaacaaaattgtgtcaccaaagggatttctttaaacttgtccgggctggggtagctccctgctctagtatcattccaaattttttcaaacattcatcttggaatgttgctgcctaatatttgcaaacaaatctaaatttattagaaagaaagttttaatgccaacctttgggaagagggtagaagtttcttagtctttttttttataatctgtcactgaattgtatagggtgaggaaaggatgagacacttatatgctgttcacatctttgtatacatgataaattaactagcagacattattactgctgtgactactttctcctggaatgctccttgcctgattaagttagtcatttgtgctttcaagttctctatgtgatggatgcaatattggtatcaaaagattaacagtaacattccttattatttaataagacatgatgttagacactaaatttgttttaggattctgacagttaatttttcaaattatagttttttctctgtcatcaaatttaaggacctgtatagctgtcttcctcaattccatcttttctatcagttttgtgaatgttataatttaatttgactagaagggatctcagtttctgatgtgaatagtgcagtttgttttacattacttgttacaatcttctcagcaatgtttccagtgttactgttgtatatcattatttttagatatatgtcaaaaaaactgatattaattttatcatttaaaaaactgaggtcctgaatcttcaataaagataaactataagaacattgtagacattaaatgtatgccagtgccatttgggtgccagtaagctacattttcaaatgcataaaagcaaggaattcttaaaacctgaattagatggaagaatctcatctatatcttttatattattaaaacaaagtaacttacagtttgactgcattaaaatccagttgtaccagctaaactcacttgtaaagtctagaaaatatttaaaactaaaagttaagttcactataagatgttttgttcactgaatattaagacctaaaagttgggaattcagaactattcaaggcatagttgcttttccttaataatatgctgaaatcataaatattttttgaaaatattttatgctaaatttaattatacatagtagttcttgagtatttttataactttgtaattatattttagttacaaagaggatattaaataaaatttgaaaaatcacttggtacttccaaattcaccaaagtaaaattctgaaaaataataatgttaatattcgtcaaattaatttgcttattgcagaactttaggagagcaagtggcttgtcttgatattttttccttagttaacacttagatgttcaaattgacagtgaattcataaaagcattatatctttttctaggaataagattatatttcttttgaataattttgatcagcactagaatgtatacctcaaagataaagttatcactctggtgtaatttttaatatacacttgaaatgctgaattagaatattaatataataaaagaaactagtttgaatgttgatattttaaaaggagttagtctattccaattaggcatctggaaataacgtttaaaaaataaattaaaggacagaaggaagtgaaatttgtctttctagtaagaaaggtctcataaatcataagactgcttaagagaatctaaactaggtgcttttataagtgctttaatatcagtgacaaatatactccttgtcttcatggagtttacaatttagtcatatattacaggttgagtatccctaatccaaatgcttgggaccagaagtgtttcagatttcagattttttcagattttggaatatttgcagatacttaaaccagttgaacatccctaatcagaaatccaaaatactccagtgaacatttcctttgtgctaaaaaagtctcagatttcagattttcagatagggatgctcaacatgtaaaataaacaggtagataataactttaataattataatttcatattaatttaataattataatttaaatacaatgcatgctaagaagaaatgaaaatgttatggtagtagaaaataatagcaggggaacttcatttagatagggtgagtagagaagacctaacatttcaccaggggcgtgaagaatgaatgaaaaccaaatgtgagcttttgtgctatgtggaggttttaggaattatattgatcaataatgaccactttaaaggcaggtgtcaccaatcaagaactcttacactaaaacttcattagtatgtgaatagtctaattcagtgatgtcaacagccaatttcaaatatctgttcttttttatttaaaataatgaatctttttgcctttccccactgagtcaaatatcaagaccatagattttagcaccgagctctgtttaataaaaaattaaaatttattttaattttttagcataaaaatttggggccgagaagtccaaaagcaatttcggggtttcaaatttgagatactgggtagacaataatgttattaactataccaaggaataaaagagaagtaccaagtcttgagggtaaaagaaaagagtttaatgcatcttgattgggaatgtgtttaatctgaggcatatgtgagacaaccaaggagtgatatccagcacaaaattggaaatacaatttgagtttgaaattcttatttttactgcatcttggttatgatatttataacttagtacatattagtgttagccaaatcccatagaaatcctttctacatttcaaattcggcatgcacagattttcatgcacagaaatgtatgtgcaaacgtattttgtctacatcagaaatacaatatagttttgaatgatcggtactagaaagagcacttgacttgataatagaagatctggatggaaatgcttttttctctacctcataaccacagtaaattaagcaagttacttaactttactgagttttgtgtctattatttgactgaccatccttacctctacaacagtgtttattaactcattaaataagtctttgcctggtagtagaatagcaacagtgagcaagtagacattgttccaacttctacaaatagatcagacaactaaaaattaaaataaagcataataaattctagaattgattatcaagaatacataatattatggaaatagctaccagaagcacttaaccaatatatagatatattgcagtataacatcctaaattatatattgaccgtttaagattctccagctatagtgagaacaaaatctataaaactataccaggtcttgatttctttttgttttttttggtaccctcattacaacctaatgaagataaccatgtattatcttttcttaacaattcttcatagattatattttctccagcaaatttgtttgctgaaattatatcgtatatagggaaaagtcatttctcttttatatcatatattttcttttaatgaaatctgactgaaatgaggaataattttcactcctcttgctttatgacagtgaagtatctttcaagaacaaagttgggatatttgactttcattgtcctgagtaaaatagtgcctaagtcaaatagtacataaattatatttaaagaagtatagacaatatctagactcaagttctaaaataatgatagtcttctaaaaatgatttgctggaagaataattctgtaattgataaattctcttttaaagtgagcatgattcatagcttagatgagtgctgattttcaattatgaaggacagcagcatctctatttagaaataaaatcaaggccgggcacagtggctcacgcctgtaatcccagcactttggaaggctaaggccagtggattgcttgaggacaggagttcgagacctgcctggccatcatggcaaaaccccatctctactaaaaatacaaaaaattagccgggtgtggtggcacatgcctgtaatcccagcttcttgggaggctgaggtgtgagaattgcttgaagctgggaggcagaggttgcagtgaaatgagatcaagccactgcagtccatcctgggcaacagaacaaaactctctctccaggaaaaaaaaaaaaaaagaaagaaaggaaaagaaatcaagaagcttaaggcagaaaataatgattacagcaaaaaataaaaatttttcaaactttcaatttaccattcattttagatgttattaaaatgaagaatatttttaaacactaattttattatcgttttattccctaaacatctgaagtttgattttgagtaagtaaatatagtctatagtcacatatgttcctgtaccttaaaagttagcaaagaattttgtgcttagaataaccagcaagttgtgttttttttttttttttttgctcttaggaagaaaatataaatactatcaatatctaattgaagttatcaatatctaaagtttatacaacaattaaaatgtagatgtattgaaatatctttatatgagggatatatacctttaatccactaatgtctaatactatattcaaacaaaatatgtaattattacttctttgtaggtttctcttactgtcctttgagcaaaagaatttagattgctctggttaagttatattcttaactcagggtttttaatgtatgagtctgaaaggcagtgtgaattcctttacctataaaaatggcactgctgattctatatcagcataatattttctctgggatgttttcctagtagtgttagtttttacaaagtattgaatattgtcactattttcctttgtgaacaccagggtgattatgtgatatggctaggtcattggctaaacctgggttcccaagtctctggagaagctcataaaatggccatacttccagcctaaatcaagtcactaactggtgacggcaaattatttttttcctatttttaagagcctaaccaaaatcaataagactatactagacatcaagcttctttgcttttgctgaaattatatcaacattggtatgacaatatgttcagctattaatgacattatagaaatagattctacacataccgtcaacacacaacaaaaaggttggaaaccagtgaattagtgagatcaaaaatacattctctgaacaaaaatatgttttcttttgtgaacatttacctcatctggggggtgttgagcaataatattctctgcattattggttagatccagcatttctcaaacatactggtctccagaccccttcatgcttttaacaattattaaggaccccaaattacttctgtttatgtgggttatatctaacaatatttgttgtactaggaattctgagggccaggcatggtggctgtaatcccatcactttgggaggccaaggcaggtggatcatctgaggtagggagttcaagaccagcctgaccaatgtggaaaaaccctgtctctaccaaaaatacagaattagccaggcgcgttggcacatgcctgtaatcccaggtactcaggaggctgaggcaggagattcgcttgaacacgggaggcggagattgctgtgagccaagatcatgccattacactccagcctgggcaacgagaacgaaactccatctagctagaaataaaaatagtaaagcctttacatgttaacataaacaacatattttatgaaaaaataagtatattttccacaaccaaagaaaatctgaaaataatggcattgttttacattttttcaaatatatgttaatatctcgcttaatagaaaatagctggattctcacatttgcttctgtattaagtcttgtaatatgttgttctgattgaagaataaacaaattgagcctcatatagatatatagttagaaaaggaaggactatattgttcacatttttttataattgtggatgttctttgataccataccaaaaatttacaatttttagtttagtaaaggttagttgaaatgttgaatctaaaaccctggctaggaccattccatactcacaccttaaaatccattggtctgtcttgcacttcaaatggatcttttacccaggcatgattttggaacacatatattggtcatttggaaaatataaattcttccaaaagttgacatattttgttatattatatcaaaaagtcaccttcattaatataatcaccaagctcatctaaaaagtctggaatgtactggaagctcttaagctcatagtggcacatagacattttctaagttctaatttatgctttgaagctagaaattgggctgggcgtggtggctcacatctgtaatcgtagcactttgggaggctgaggcaggcgggtcacttgaggtcaggagttcgagaccagcctggccaacatggtaaaaccctgtctgtactgaaaacacaaaaattagccaggtgtggtggtacatgcctgtagtcccagctgcttgggaggctgaggcaggagaatcacttgaacccaagaggtggaggctgcagtgagccgagattgcaccattgcactccagccggggcaaaagagcaagagtctgtctcaaaaaaaaaaaaaaaaagaaagaaaaaaaagaaaaaagctagaaatagtattactggcaaaaaagcaacaaatagttttttcttaaattgacagactttgtttatttttgagaaaatgtataccaaacatctaagtctgaataataataatttattagttatttcattctttcaagtaaaaatggtattctgtattaaaaactagctattcagcttacaactcaaacaattgcataaataagtgattttccttgagacaaccaccatcctttggtatgcagaagtattttgttcatacgccccattttgtcacattcaaggctcaagttttaattaatttaattttcccattttgtcacattcaagggccaagttttaattaattttaattaattaaatttaatttaactaatattaaatagtaaatttaatgtgtattaatattgtcatataatattgtaattactcatgtaaatgtaaatattacattgaggatatagtaaatattaaatttactatgtcattgaggacagtatttcaaactagcttttttaaaaagaaaaacagaagatggcagtgaatagaacagtgattgttcatactacttggatctactgccttaatttatactaggatgtcaatccaccattgattttgtaccatcagtgcaaatgtcaacgtagccaaaaaggcaaataatgtctgagtactattactaaaataattttgactttgtcaagccctgaaagggtctccaggaccctcatgggtttgtggatcaacttaaagaaccattgataaaatcaaatgagcaaactggcttatgtttcttgaaaatattctggatgaaaatgatggctattgaatcctttatatatatattttttttccatagaagcagtattatagtggtatactcagtccaagagatctgatccaatgactaccggtaccatggttaagcattataaatagtttacctgtcctctgtgatccaggttaatcctagggcagggaacacctacacctctctgattccaatgacagacttcattaaatttttgaagatataagaccagaagttataattcccagctaactccattcattttcaatgtggtattacttctgcacttggataataactaattttccccaggatattctgtctactaatagataacatacaaagccctcttttaagaaataggccagacgtggtggctcacacctgtaattccagcactttggaacgccaaggcgggtggatcacctgatgtcaggatttaagaccagcttggtcaacatgctgaaaccctgtctctactaaaaatacaaaaatttagctgggcgtggtggtgggcgcctgtaatcccagctactcgggaggctgaggcaggagaatcgcttgaacccgagaggcggaggttgcagtgagctgagctcacgccactgccgtctagactggtgacagagcaagactctgtctcaaaaaacaaaaaaagaaaagaaaaaaagaaataacctggttgttggcagataattctattgagtatataactggggatagctcatttttgaaatcagtttagaacatttaaaatgtgggaaattcaaataaaaatgcaaattttcactgttttctaaaaagtcagatcaacattgctggcccaccactgatataatactctatatcaatactcagctaatattctttagaccctccagactattttactcacttacattaaatgcctgactcctatggacatttaagtaactgatttctgccctaattctctgttatctaatttctcctcccttataacatgtttgtttggggatttattctcatttgttagcgaagcagaattttgagacttcaaataaaagacaattcctttacacccttttctaatgagaaaggcactacctagtatgggaaagaatttaatattttgatgaaactaaaattacacaataaagcattttaactatttttggtctataacttattttcaatagttttcctctgatgttctgctgggtatgtaggattttacctcgatttttcttttttcgttcatgcaagtgtcccctttgtttttcattataattatcattataatgataattgaaaatgaaacttccccatctatttctaattatttaatggtcacagagctatgtttattactgaagctaaatgtaacaactatgaaatgtataattgccactctgaagtctaaacttgcaaatgaaatttgatatctgagaagatatagcaaaccaaaaattgctaactgtagaattaacattttatagctaagacagactgtaagtggtatagtttctgtatagtttcttttttgtttaaaaaaaatgtacttactcatttggaaaaaatttttaaaattcacataaaaaagttcttataaaatacccttcataaataaccactgttaaaattttgctatgtatcattctcttatgtttttctatgcatttaaattcttatcataccaagaaggcagtgattaagagctcagtttctggagtctgacaggcctgatgatgaatcacttaatacatgtgtggctttcaaaaagttacttcacctctataaccttaattatctcatctgtaaaatgaaaaataatgatactatttgcttcatagggttgtcttaagaatttaagttaaaaatgtatataaatcacagcacaatgattaaaatataagtactcattaaacagtagccattattattaaattgtctatagcttttaacctatcttgcttacttagtaatatgagcatctttctatgtcatgaacatctttatatgttgtaaattaccttctacaatattacttggatttttgatattctaattgatagatgtgacatagttttttcaccaacccgtattttggatatttttgttgtgtcttattttctagttttaaaaacaatgctgtagataatctttcagaagttaaaggttttggagtcatctcttaatcaaactcagtaacttctgttatttctacttttattgaaagtatatgcagaacttttaggtctaagatttctatattttacattgacagcaggaatagatcatttttatgtcttcatgagtttaatgatatattggaagaagcagtttttagcatttgcatttgactgatttactggcagacatttaaaaactataaacccaaagtcgtctgaaaagctaacaagcttgagtgtgtaaaaatattatactgcgaggcacagcatattgagtaccagccctaggctaccatattataactttatgagggctgggcacagtggctcatgcctataatcccagcactttgggaggccaaggagggaggatcactgaagcccaggagttcaggaccagcctgggcaacatagtgagaccctgtctctacaaaaaaaaaaaaaatttaattagctgggcatggtggtaagtgcctatagtgccagctactcaggagaatcacttgaacccaggcggttaaggctgcagtgagctgtgatgatgccactgcactcccagcctgggtgacaaagcaaggctctgtctcaaaaaataataaataaataaaactatgaggactagttgacctcagtttctgttatttgtaacaccaagatattaaataacctctaaagtcccttgtaggcttataattcttttcttttgaaatagttccagtatcaactaaaaaatatttttaagcccttctctctctgatattttattaatctccaattaatacagaataatttacatgtgtttatcttttgcattctgttctagtacataaagtactagagacagagattattaacagaaaatgttctaacttcacttaagatcttttacatttaggtaaagcttgtctctgttaaatgaaatattgatttctctcgatatccactctagttttgttcaagttatgagaagatagggaagtgaactgttgaaatacaagaaattgtgaaattaagaatactagcattcagtataattaaatagctttgattcatttcaactgtttttaattgtttgggacatattttgtataaaacagcccaacaaatataagtggtccgtcctatcattatttcagcaacaaaatttgttagatattggcatgatttagagctatttaatatcccattttgactttaatatagagtacatcccatagtaaactatcctctggatcttcatatcttacaaggatacatattctaaaattaggtattttctggcccaaaatttcaggattatctccctactcattctacttttgttaaagagaaaacacagagtaattcagaaattcattgaatatttcagtgaatatttttaaatgcatattatatgtcaaatactgtattagctattggggatacagcaatgaatagacattttaaccctgttcttaaggagcttatagtggtaatatgtgaaaataaaatatttacaagaaatctaccatatacagggttgacaacctcaaagagctcttctaatccagtaggaaaaagtaaaaaaaggatgagtaaaaggtaagcatagtcatttaataaaataaatacatgcagcacagaaatatgtggggggggggggagtacactctcactagaaatctactaaaaatttaaaacaacacaaattttgcaatcaaattgatgactatttaaaaactataatcatcagtactgtaatgagcaatgacatgagtatttcttttcagactaataggaatataacctttcaagcaataaattcgtataacctttcatacacatgtgttgtatacctgtgttctctacttaaaaagtatatacaggccgggcgcggtggctcatgcctgtaatcccagtactttgggaggccgaggcggatggatcacgaggccaggagatcgagaccatcctgactaacacggagaaaccctgtctctgctaaaaatacaaaaaattagctgggcatggtggtgggcgcctgtagtcccagctacttggaaggctgaggcaggagaatcacttgaacccgggaggcggaggttgcagtgagccaagatcgcgccattgcactccagcctgggtgacagagcgagaccccatctcaaaaaaaaaaaattatgttttaatcagtcattttgtctctagaaatgtatccaaaataaattattaaagaggccatctcaaactatgtacaggaatttttatcacagcattatttatatttgtgaaaaattagaaataattttaatgtgtatggaaaataacttgtattaatagtacacacatatataagttattctataaccttaaaaatcatctcattaagaatatttaatgacatgagaaaatgctgaaactacaatgtatagtttaaaaattagtaaacaatactgtgtaggaatagaatagcaaattatttcacaatatacattatttttaaaaccaggaaaatatacatatctgtttggtttttgtttgtgtattttttagataggatctggtaattacacggatgtcctttggcctatttttcagatttgtagccaaacttaataaagccaactagagttatttatacctatatttacaggcataccttggagatattgtaggttcagttgcagaccactgcaataaagcaaaaattgcaataaagtgagtcacacaaatttttcggtatcccagtacctgtaaaaattatgtttatactctcctgtagtctattaagtgtgaaaaggattatgtctaaaaaaacacactgtgcataccttaattaaaaaatacgttagtcctaaaccgttattacaatcatctgagccatcagcaggtcataatctttttgctggtagagggtcttgcctcaatgctgatggctgctgactgatcagggtagtggctgctgaaggctggtgtggctgtggcaatttcttaaaatcagacaagtttgccagatcgattgacccttcctttcacaagagattttgctgtagaatgcaatgttgtttgaatgcattttttctacagtgaaacttccttcaaaattggagtcaatcctctcaaaccctgctgctgcttaatcaagtttatttatgtaaaatcatttgttgtaattccaacaaagttcacagcatctttaccaggagtagatttcatctcaaggaactcctttctttgttccttcataagaagaaacttgtcatctgtgaaagttttatcatgagtatcacagtaattcagtcgcaacttcaggctccccttctaattgtagttcttttgctatttctaccacatctgcagttctttctcctccaccgaagtcttcaactcctaaacatccatatggttggaatcaacttcttccaactcctattaatgttgatattctgggctcccatgaaccaaaaatgttctgaatggcatctaaaataatgaattatttctggatggttttcaatttactttgctcagatcaattataggaattactatatggcaactgtatagccttacgaaatctatttttaaaataataacatttgaatgttgaaattacttcttgatctgtagggtgaagagtggatgttgtattagcaggcatgaaaacattatctccttgtatatcccaatcagagctcttggatgactaggtacaatgtcaatgaatacttatattttgaaaggaatctttttgtctaagcagtggatttaacatatttagtaaaccatgctgcaaaaagatgtgctgtcatctaggctttcttgttccatttgtagagcacaggcagggtagattttgcataattcttaaaggccatagtacttccagaatggtcactaatcatcggcttccacttaaagtcagcagctgcattattccctaccaagatagtcatccagtccttttaagttttaaagccaggctttaacttcacctctctagcaatgaaagtcctagatgacatctgcttccatttatataaggctgttttatctacactgaaaatctgttgtttagtatagctgccttcatcaaggattttagctagattttctgggtaacttgctgcagcttctacagcagcacttgctgcttcacattgctcttatgttatagagacatcttctttccttagacctcatgagccaacctcagctagctttcaacttttcttctgcagtttcctcaccttactcagcattcatagacttgaagaaagttacagccttggtctggatttggctttggctttaaggactgttgtgactggtttggtcttctatccagatcactcagactttctccatattagcaataaggctgtttcactttcttctcattcatatgttcactggcgtaccactttaaatttccttccagaacttttcctttgcatttacaactcagctgtttgacacaagtagcctagctttctggctgtgtcagcgttcagcatgccttcctcactaaacttagtcatttctagcttttgatttaaagtggtagacatgcaactattccttctacttgaactcttagaggccactgtaggtttattaattggcctaatttcaatattattatgtctcagggaatagagaggccagcccacagagaggtagaaagacaaggaatggtcagtctgtgtagcagtcagggcacacacagcatttatcagttcagttcactatcttacatgggcaccatttgtggtacctcaaaacaattgcaaaagtagcatcaaagatcgctgatcatagacaaccataacagatataatcatagtaaaaagtttgaaatattgtaagaattatcaaaatgtgacacagagacaggaagtgagcacttgctgttggaaaattggtgacgatagattcgcttaacacagggtagccacagacaaaccttgaacttgtaaaaaatgcaattatccatgaagcacggtaaaacgaggtatgcctgtataccacagcatttttacatccaggctaagccagtctcttcttaatcctgctggatagaaaattttatcatatttcagtgaaagttcaaagataaacttttttttggtctcatgtgcaaataataaaaaaaattaagaacatataatgtgctgcctaaaggttatttattttaacccacataataactcttttattaaagatgggttttataatttctttttagacagataagaaatttggaaaaaataatttcagtttaattattctctagttagtgaacaggaaataatttatataaaggtctaattttatatagattagatttaaaggtctaattttgtatagattatactgtcttggaattaaaactatatagaactttaagatcaaaattataaatgtgtaataaaatataaataaataaatgcaaatgttaatatatcattagacatcagaacctttaaaaaagatgatttcctggctgggtgcagtggcttacacctgtaatctcagcactttgggaggccaaggcaggagtatcacctgaggtcgggagtttgagaccagcctgaccaacatggagaaaccttgtctctattaaaaacacaaaattagctgggtgtgtggtgcatgcctgtaatcccagctactcgggaggctgaggcaggagaatcacttgaacccgggaggcagaggttgcggtgagccgagattgcgccattacattccagcctgggcaacaagagtgaaactccgtctcaaaagaaaaagatttcctaaggataaaaatatggcagaggggtttagaggatctgtaacttgccaccatgattctaacttttgacttctcacttcttactctttgcaactttccttgaccttttttatccttttattagtttagttttataattgtatttcctttcctccagaaacacattagcaattatttttccttgacacatttgtatattaatcacctctctttcatttctttcttccttcctttatacttatcttaataaatcacaaattaaaatgttctatgatgaggcaccagctttactgaaagggctgaataatataatattatagtgaagtgaaatattaacttaattccaaaagtactttgttatttataggaatttgtttaaatgttgagctcttaagcaaaactttaaaaaaaaaatctctttctccaaatcatagctaccagaaacgatctatagctgccccaatatatactgagtgatactggttggaaaataatttctaagaaaaaagttttatttcttttcattgataatcataatttttttaaaaagccatgatatggtataataaggttaaaaatattagtctcagaatagttctgaaggtaaactagatctaaaaataaaatggccaactccttagcacaaacaaacagaaagaaatgttggtttaatctatgtaattttattctaaactgatacaaaatgtattatggagagaaggggagaaggtctacattcgttattccataggtaagagactaaatttaattaaacaacctgagagtcagaaggtaatatcagctgtactttcatattatttattgatgcattcagaaagccactgaacttctccagaccttggttcccttatcagtaaaagaaacacacaaaatatacaacattttctaaaacattttcactaaacattttgtaactaaagaaaaatatgaatgtatatacccagtgatatgtgagtgtaccttaatgcagttatcataagcctgaaatttctttgaagttttgtattttattttaaaaattaatatcaagttgatttttaagctatgaaatatatgtttggtttaattaaaatactacatttacaattatttttggcaagagaagtgagggtggggctagatagttttctaccttgttaatggtagaaatcgttttcagtgagctcagttttgggaaactgagctaaatcaaagggaatcaacatcacatattagtttaggatccaggcaatttcttttgttgcataatattactagaatccaaattcttggaaaaaaaagtaaatagaaatgtcaaagtcattttactacaggccagatcctggtaattaatcactgaggatagtttccccagtaattaatccctgaggaaagattcccagaatgttgcaaaagaggtaatacagtgcaacattttcagaatatttctaaggaatactttgttaaatatattctagttgagagactgaatagaagattgaagtattttggatcccatggataatatcttttaacatcttggtaaaatacttgtcaaaagatttcttcatgattaatgatgacattttttgttttgctcctaaattttgattatcaatatatataagtaaactagtaatctcaatttactccacaatcctcacaattatttacattcaattctcagactttgtttataatgccgtgatagtacaatataaacatttacagtttaacctctcttagctactgatagtgttttgcctttagaaaagtatgaataaaaatagctaatgatgtgaagctcttattattaagaatagtaaagtcattcatcttatctgaatgctaatcttttgtgatttcttttaaattcttatctaaaatgtaataatcaagcatttggccgggcacggtggctcacgcctgtaatcctggcacttttgggaggccgaggcaggcggatcacataaggtcaggagttcaagagcagcctggccaacatggtgaaaccctgtctctactaaaaatataaaaattagccaggtgcagtggtgtgcacctgtaatctcagctattcaggaggctgaggccggagaattgcttgaacccaggaggcagaggttgcggtgagctgagatcatgccactgcactccagcctggatgacagagccagactccatctcaaaaaaataataataataatcaagcatttggattagctgtgaatttcttttatgtatactaccccactataactgatgattaatggaggactaaaataaataaggacattacattttaaatctactgatttcacttttctctatttctcaaattctagtttatatagacatccttttcaaattctttctgaagtttttcagtattaggtattattgttacctgtttcagaagctgcaaaaaaatcacatgaaacttgaattgtagccagatgaaacttgaattgtagccatttctggctttgaaaaacaccttggctttctaaggttttcctcttatgatggtttcaaagacaggcttgtttatagaaatttgaaatcaagcattgatgagtggtttgctcccaaagtctctatataaatcagtcttataatctagtttttacattcagagtttagtggtaactgtctttttttcttcttataattcattgtttaagtttctatacttgcatttggaactgaaatggtacaggaaaaatgtcttccatatatatagtaacgtaaaatttcttccacagatggagagagacagacagacatagtacatatacatacacattctgttataagcattaatttttttccatcccatatattttcaggcctgctaagggaatgctactttaaactagaaattagggactgttgatttcgttcttagatttgtcatcaacttccagtgtaaccttgaaaaagatacctaatgttgctgagcttaatgtaattttaagccttctggaaataaaagacaacatagaaaatggtgttcacttattactgtgtaagttcagaacatcttcacagtttctgaaaattttcagaaagcctcatgaggcatcagactcttatatttttataggaatctaccaactctacctttataatctagatattgtgaatctgcatttaagatggaaaacagcttttgatataaagacctcagaaatcaaagaaaacagcacaagaggatgagcagatattatgaactcactctgaattcactccatagggagcccctctcttataggtgctgatgttctagttagtatccattgtttctaaatttgacaattctgttccactaagaatagtaagaattggtgattatcttttggccataacatttagttaatgctgaaaaattagtaaaacttgtttatatccagtagagccaaaagttgatgcaactcttatatagcaatatgcttttattcaaaacgaaaattccattttctcaatatgattattcctcagcaatttccatatgctatcagagatcttctaaaagggataagacaatatatatcctgcttccaggaaataaaattttataggatgttcaggtttctattatttcttgaagactttaactgggaacttttggcatcacactgatatttctgctatctcctaatataagcaggaacatcacagctaacttgacctatgctggtctgaattgagacctcattctggaatccatagtgtaaaaccacttagtctgaagcttcctatcccctttgctcttcaccctgccgttttttttttattgcctccctctttatccaaaacattagttctcattagagctctatttaaaaagtacctcctctaataaaacattttgtgttgagaaacttcccttgctcatttatgcagtaatgtgaaatgagttattttaaaaaaaaagttttacttttcatttcccgtcttacccaagatagcaaattttccaagaggaaaattcagctaaaataactgaaagctttgaggcagtaaatatatctaacattggtctggcattaaaattttctggttgggcagcacaattgtttaattgggaatctcagtgacagctgaacaacctcaatgcttgggtcagcaagcagaggagcttcactctgtcacctatcaagaatgatgcttgtcaggactgatctttccacctacagagcattcatgtttctagtcataccatttatgttttctaatattacaatggaatagacactaaaacactaagagagaaaagtacataggtatatttgtaattctttgttttttgtaagccaaatgcaaatgtaacactactccagatactgcttcatcagaagtccccaagataaccaaaagtaagtgccaatttcctcatctcagggatagtgccataacaaagactgaattctagggaccagcctatttgcagagcatgtcatacagcctctgggttagttaactccttggcctcctaagagctaccacagagagtcaattgatgtttttgcatgtattacttactaatgtatagaaaaatttttaagttcactttttctttattctgtctttcttacccatcttccctcattgtagcaaattagacggccggatgaaagcaaaggagttgctagtagagttggatccctcaaagtaaatatgtttctaacattttttggcaagatttcgtctatagcctacacttcttcctttttggagggtggtgggaggaagggggctttttccatttttcaccatcccattttttttattttaatatttttattggctgttgggtcatattactttttttttgtttcagctacacatagagcaaccagctgaaggcaagctgccaaataactagctttgaatggcaccacaaacaacagaaagggcaactgcctcattacaggtgcctataatttggggttctagaataaaccgttcctctgattgatgtcactgtgtgttaagttcctgttacacagagaactaacatttattttcagaatattatctccccttttagcttttttttgtaaaaaaaataattttaatgttattttggtatcatcaccatttatagttcatttcagagaaaagttattatgagttaacaatatgtattcaatacacataatcttaagaaattgaaagaaagaaattttatgtcatgtagtataatgggcccacatatagctgatagtagttatgccctcttaatcccctctgttttattttttaaatttcaaaaaactgatacaacaatcaacagaaccagatacatacctaaatgtttgtccatttgtgtatataacctgctaatatacaattgaaagatttctaatttgatcatcttgtttgctagttgctaaatatttatttgctcaatatgccttgggcactcagtactcaaacatttaatcataatgaaaaggtaaataagttatcactcttatgaaacacagaccaatcacatttaatgctgccaccttaaatgcaagttagaaaatttgctgaattctaaaaatatgcagaagaattacctcacaaaagtaattattttcttatatctcaatctcatttgccctaacagcaatagtaactgttaaattaatcaaaatgctagaaaattcagtgcactgggatgtcctaaaatttaatgactaccttgaggcctaatattcaatcatttcaaaattttgcacacctccaatttatttccattttacaatttatgaaatactaatttctgcactctttcctctccttgcctcttctgccttcttagctttacttttttgttattgtttatttgtttgtgtgtgcgcacgcacatgagtgcacatggatgaaggtgtgtttgtatgtttgtgtcctttatttcagaaaagccatcctctctgttctctaacactgctttatagtggatagctattttattaaaatgttatttcaccaaggataagaagaggggatgggaagtgttaatagtgtgcctatttcaaaaactaggcaatttaagattattcagtcagaaaaatgtgagtttgtgtatcctgatgatatatcagtagcattcctcactgtctatctgtgaggtatcatattttatctttgtctttaaaggaagataaatccattaatggtttaaactatggattatgactcaaattcaggtgagaaggtacagaacgacatgactttttgaaaattactgaaggtgaaataaagataaaaatggcatccataactgtagcaccatgtactgtaaactggattgtatgtgcgagtgcgcgtgcgtgcagttatctccgagttcaacttctggatgtatagaacttcaagttataaatgtatgtttattgtttttaagtgtatatacaatatgagtatgtatatacacatatatatgtttaagaacaaaagatacgttttataattaaatcagtttatattaatatggatgcagtcttgaatcaaaaagtgtgtttgggaaagaaagtcaaatttcataatatttaaatatctttactccatgtttctacaaaatagaaaatgtcaaagtgaatctctaggggatttataaggatggttatagtatttattttctctaatgctttggggagaaaagatgctgtaattaatcaaaataaaatgttgacttcctagtcacgggtttgttgagcatgcattcttacgttatagaaagacctttgatgtttgaaatgtttgccaaaggcagtgagaaatgtataatgctatgatcttatttttaaaaggaaaaaggaaaaccgaaaagagaacaagttgctttttcaattcattttctgatgtttacatgtagctccatcgaaagctggaggagctcagagatcacctagaaggcaatgtgaaaggatactctctcagagtaaatgtacgatttcacttggtgatttttttttccctaaacttctgctgactggtaactccaaatctgattggtttgtcctctcatctccatctttttcctttctgtctcttttccccctctttctttcttttctagctgcggcttcatgctcccatttatgaaataaagattaaattagcagggtagaggaccctaaagccacactgactaacattgctgttgacttaataatattttggccccagtgcaaaataaaatctttcttttcaaaaatcactatttcttatacaattgtatacttttttgaggatcttgtcatgagacttcatttggagatttttctattggtcatgtcttctaccccttgttagttatgtcagcagaataataaattatgagctggatgtgaggggtatatccttgatggtacaatttcaattttcaaggaaaataatcagtgttagggtatcataggtaatctggcaagtagacacatttgttctgagttaatagacttaactcagactcttttagaataaatgtatgtcattttgtttaaaaataagaaaattagcagtaagtaccttcaccaggaacaccttcacgtagcatcttacaaatacttgagctaaagtctaatatacccaagacaaccattgaaggaggacagtacctcgtatccactcaatcctgtacattcatcatatagtcagaattcatgatagtattttttgtgacagatagttcagactatcaagattttcaagaaaaatctctaaattggttttggtataaatgtagcagaagaaaaactaaattactacagtaatttatggctttcatttctggggtttccaagaaagttcctgtgaatcctggtatccgatttacttctcacaaggttattaccattcatttaattcacacagctgtaatagttttgttataaaaactagaattaaagttagggatatgataattatcttatttctcagcttgtttttaattgtataccacacatagtcatgtgtatctctacgctaaatttctgattattgaaatacaaagtgatttttattaataagttgttaattctaataactaaacagaaggaattaatacacgtgtctcatatctctacttcttcctttgagctactctttgttttctgcacatattcttatagaattttgaaaaccatccataatcactccccaaaacctattttgtcattttttttaaaaaaaagattagtatggattttatgattaaatcagtctggacatacctaattattctagaaacccataaaaatattttaatatgtgtattttagtcttgtgctctttcctaatcagtcatgagaagtaatttttcttttcaatgaaactgagaccaaaaagttgagacttgctgatttctgtatggtaataagttagtaagagaccaacatcaaatttaaaatttgatgccttaaaaattaggttatctcatgccattatttaatttcttttttcaacacctgtactactatataatgattaatctcattttatttcactgagaaacactttgttctgattaccttgtttctaaaaatattaaatataaggtgtatctgtctaaggatcctgttaactgtccaatatagaaaaaaaaaaaaaaaaaacctatccaaaggcaagtagtatcttctctagagagttcagctaaggaaacatgcaaatcaattgcttagctgaattttcagtttctctccttaccctttaattcctactacccaagtataccttaaagtgccttgaatattaaaaattgatgctaaaaagaaaaagttattctcagaaccatagactatattagacaggttttgtttctaaaatgaagtaaattggcattcggtgatgattttgtttcatgaaaatttattgtaggtgtacacacacaagaacaagtgtattagtccatttccacattgccataaagatactacctgagactgggtaatttataaagaaaaaaggtccaattgactcacagttccacatggtttgagaggcctcaggaaacttacaatcatggcggaaggtgaaggggaaacaaggtacgttgtatatggcggcaggaggggagagagcacagggaaaactgccacttttaaaaccatcagatctagtgagaactccctcactatttacaagaacagcatggagaaaaccacctccatgatcctatcaccttccaccaggttcctcccttgacatgtggagattacaattcgagatgagatttgggtggagacacagagccaaaccatatcaacaagtatatgaggtgtcttttacttcattaaaatgctggtgaagatttcaattagatgaaagagtcagaaccatgttccttatacaattgtataattttctgaggatcttctcatgagacttcatttggagatttttctgttggtcgcgtcttctacccttagttatgtcagcatgattacagattatgagctggatctgagggttacagccttgatgattcaatttcaattttcaaggaaaataattactattagagtatcatcataggtaatctggcaactaagcacatttgttctgaattaacagacttaactcagactcttatgtacataacctacagttacttttacataacagcagagttgaatagatgaaacacagattatgtggcccataaagtctaatattttatttaatagttaaattttaaaaaattcaattaaatattttattttatggagaatttaagatatcattcagaagtgcaggatgaagatttaatttgctaatagtttaatttgctaataaataaaaattaaaatattttaaaattaaatatttaatatagaaggtttgacatcattcagaagtgtgagataaggatttaattaaatcattaatgcttgaattggatgatgtagacaatatgttattttgtagaaagggaagagccctgtaccactattgattaaggataatgtaatcaacaatataaaatagaatattctaagatacaatgttttgaataatgtttatttctcatattaaaatgtattatttattcaacattgattcataaaatgggatgtattagattattgatttttaacttaaaaatgcatcatctttttctctatatcattcaaagcagaagtattttgaactttaagtgcgtttttagtaattttagtaataataaaatcatcatcttgtacctaagcagaattttactaccttaatgactacaaaaattactacaaatccttagattggtgatgtgctgatagtaactgaagaataaaaccacatagaggaaaaattaattttccatttagtcaaatggatgaatctattaagaagaatattaaaagtaatgcacaggcttgaaggccagtgaagacaatgttgagaattgaaaaacacaggataaggcaggggacggtggctcatgcctgtaacccagcactttgggaagcctcactgagaaacactttgttccgattaccttgtttctaaaaatattaaatatgaagtatatcagtctaaggatcctattaactgtccaatatagcaaaaaaaaaaaaaaatttaaaggcaagtagtatcctccctacttgcgggctgatcacttgagaccaagggaaaaacctcctgtctactaaaaatacaaaaaattagccaggcatggtggcatatgcctataatcccagctacttgggaggctgaggcacaagaatgatttgaacccaggaagtggaggttgcagtgagccaggatcgctctgctgcactccagcctgggcaacagagtgagaccctgtctaaaaaaaaaaaaaaaaagaaaagaaaagaaaaacatagaataagataatccaaagtaatactttctttacagaatataaatcaaggtaaatttacaaagaatttgattagttgacgagcagtggggccaaagagagcctaaatattaagatattcaggaaaaaagtagataaatgttcatgaaataaagatagttaaaagaaaagaaaggaaaggaatgaaaatactcatatgccacaattttgtattttcatctgaatactcagtttatgtattatgatattaaatttctattcagctacaaatatgtgtagataggttttggctgaccaagtgtgatttttttaagggctatgataaacaaaaaggaatatggttcatgaagacagattactggcatataagtgaaactaagatggaaagtgatgaaatggaaggaatatgacaattatctataagtacttaactatactaacacaaattaaaggatggtatttaaagtgaaaaaagtcaagggaggagttgtcacccaaaataagactacctttttaataagtgttaagaaaaatacctgaatcaagttagaaagtaatgatcttttgaaccatgatttttaaatgtttaacaattaatttcctgaatgccaatatgggatagtatgaaatagtgctaatataaataatgaattgggtaactgtgattttatagatctttaaagatgagtattttcattgcagccttagctctgaactactttcttatatttttgataaatagatacctattgtctttaggggggttttgtacttttatttttattgagttaatgcgataactcagagatcagcaaatcctgtttttttataggcccacaagctaagaatgagttttgcatttataaattgtggagaaacataaaaagaagaacattttatggcatgtgaaaattatatgagattcaaatttcagtgtttaaaaataatgttttattaaattataaccatgctcattcatttgcacataacctgcagttacttacacaacagcagagttgaatagttgaaacacagattatatgtctcatacagtctaaaatatttactctctatttaaacagaaatgtttgctgagtcctgctgtaactggttagtgtgtcaaaataacgttgacgtaggaatggttataatggagtttgtgaaatttcttcattttaaagcttgagaaaagaagcctgctcatttttctgaggatggtttcagattattctacaaggaagcatatgtttggaaaggttgatctcctcaaattgtctacctttacatttttattttcttcttttttattgtcttctctagctattctctctctctcttcacatagatttccccctctacacacacacatacacacaaagtcttcaaatatggaactctaatgtggatagaatatagattataaatttctcttttattggaggctcatttctgggttttcagagtacaaagataaatctcattattgctgtcttaaatgttatataaaatatgttattagagtattttcatttaacacattgcatttttctatttattacttcattacgtcttaacaaagatatttcccctgaagaccatgatgaacttttgatttttgctaaatgccctgtttggcctcacctaaaatcatataccttctatgggaaattttatacaactggaaaagatacactgacatgatcaagtaatatatcataccttaaaaatctaaatggtatttgaatcgaatcagctaactttgagtggggaagaacagatgaaacattagtccctagataagtaaatatttaatagtccttaggtgagcaaacagtttgtaaactctacttactttaagcaaatttgagtgtctcttgattcttttatgtagaacattgtttgagccttccttgtttggcattttggcatttacttatattaataatattcatttatttactatttcatttataataattatgtaacatctgagtatcttggtagatgatgtcttataaatatgaccagactacaataatgatgaagataacagtaagtcaattttaggattatgtctttggactaattttgagtaattttgctacttttcactttattattattctcttaatgtagttagtccaattctaaggtttcagttataaaaataagaaaaaatggccaagcgcagtggctcacgcctgtaattccagcactttgggaggccgaggcgagtgggtcacctgaggtcaggagttcaagaccagcctggccaacatggtgaaaccccatctctactaaaaatacaaaaattagccgggcatgatggtgggtgccagtattcccacttactcggaaggctgaagcgagagaattgcttgaacccaggaggcggaagttgcagtgagccgagatcacgccattgcactccagcctgggcaactgagtaaaactgtctcaaaaaaaagaaaaaagaaaaagaaaaatctatcttatcctgtgctttaaacaaaaaaaaaatctcatgatattaataaaatcacctgcagtggcctaagacattatttagaatggaagtgacccatttctgagatgtttaatgtgcaccatagaattgccctcctcggaactgactttaattcaaagataaagtactaataaaatatctcaagtaaattttcctagcaatagaaaatagagaactgagtaaattttaacaatgacaacactctcaaactgttttgaaagataaagtatttcagttttatgggcatagatatagacacagaacaaacatacacagcaagattttcttagaactagcattttgctaaagaaattcagatatgtgtatggctgaaaaatgtgtaatttctgaacatgtatagaatttaccatattttcaaaagtacctctaagcaataagtggctatgatactttttagcacaaatctttgtgatagttttaaaaattctgagcattatttcatcagttcagttttttaagatagaagaaaaagggtttgtatattcatttattaaataaacatatattgagcacctactacattctgctatgcttggcactggaaatacagttaaagaacaaatcttagataataagtgcatttgtgattcttctactgtcaccttctccagtaccttcatttccccaccgtacctttgtgttttgatacttcctgcagtatttgtaaatagagaatacatacttaacaacttcatcttacatggcattgtgagacaacctaacgagaaaagagtacacagaattgaacatggcagtgtgacaacgtagaaaataagaacagggaagaacattatcagttcagcatcataaaggttaaacattgttgtaagtataaaatagctatttttaaaaatcagtgataaaatagctgttccaaaaattctgtgaatcattctgataaaggttaagtctgttgaagagttgtgtgtttaagtttttatatttttatagtgttgctattgccattatattgtagaaagtgcctcaaagcaataagtggcaatgatactttttcgcacaactctttctgattgtaagctttaaaattcctgaatgttatttcataagttcagttttctaagaatagaagaaaagggatttgtattttcattcattaaataagcatttattgagcacctactacattctgctgtgcttggcactggaaatacagttaaagaacaaatctgataataagtgcatttctgattcttctactgtcatctttcttcagtggagaaagagaggttcagtaataccaaaaatggaatagttgaaacaggaaaaaagaatcagaatactggctttggtgccctctttaatgaatactgtgaacgtgtatggtagagttattctataaacaacctcccatgtagttcactagtgttaagccagtgaagatcagtgcagtaccgtaagaaaaattgtccagcgttctgctttctttcttaaatgaggatcttctcagcaagatcataccagattctgaacagagggagtcatctccatcatggatttttttttagcaaggtattttttgtcacaaagttttccttcaaataacttgagtcttgacatgttttcaaactcaagtgtctgcttataaagctgttttattatctggccaagtgtgttggtgatggagccatctaaaccctctgtgacccttactatgctatcctttcctctttaacagtgttttcttttccccactgcaaaaccaggctcggcttccctcgtgctcatctacctatagtgtatctgaggtatattttgcacgtgttttcttacatggtcaataacatgctcgccctcaccatttttctcattttattttcctttcgccttaatttattttgccttgcactttgcacttgcctgaaagggatgaggataccaaagggggaaaattcacctgttttagggggaaatttctctatttttatgaatgatgcactgttgtctgaataacttttttttggcagtcactacatcacattgaaataactaaaacccagatagccaacttgattgctgtgactacctttattccataatgactcttttgaattaggtaatttattattaaactcaaattggctaaaggcaagattccagtttgtatatctatatatgtctgtgtctgatagctgaagatttgtattcaattagtgattgttgtgtctcattaaccacagacataggaaaacatccaaaattgattattaaatagaaaataaatatacatctattttatataaaataaaagatgtatcccttttttaaaatctcattagatgactttaataattttttgctacttatattttcctaagattcttgtaatctagaagagattaacagtaaagagattcatgttcttttagtaaaatattttacatgaaatttggcctattttccttgtcttttaggaggtttaattttttatccttactgtgttaaactatagaataaatgagttttcttgttttcaaaaagcagatttattgaaatattattaacagactttgaatatccattaagtctcctttcaaagcaggggcactgtttgagtagctaagaagaaagagtatgtaccttgaaatatgacaggtaaataaaagaacttcaggccaggtgcagtggctcacacctgtaatcccagcactttgtgaggccgagatgggtggatcacttgaggtcaggagtttgagaccagcctggccaacatggtgaaaccccgtctctactaaaaatataaaaaattagccagacgtggtggcgcacacctgtaatcccagctactcgagaggctgaggcaggagaatcacttgaacccgggaggcagaggttgcagtgagccaagatcgtgcaattgcactctagcctgggcgatagagtgagacttcgtcttaaaaaaaaaaaaaaaaaaaaaggacttcagtagcctatgaattttaagaccttcattctttttttacaacataatttctacatgtatttactttgtataggccactgtagctaccatattaaagccagtattatcagcttaattctgattgcagaaatattatctcagaatgtcatcccaaagaaaacccttgaaagatagtactgtttaaaatacgaggtagtatatgcagaaccagaggcagaataccatctgcagatctcaaattttaagaaaaaaccaaaagaaatagcatgacaaacccatagcctcacaaagttgaatttattgagtcaatagaattgcagctatcttcttcaatttttaactttgcaagttataactgtgagatttttttctcttaaaactgatttcctggggagttaacttcttgaaacataccactagggagaagcaaagaaaagaaagccaaatgagctatttttagtatcaacaaagacatttgaaagagaaggttggtatcatctcatcaccacattttctataggtcttttcttaattcccaaagattatgagtgctagtgtaaaaaatatataacccatttctttttgccacttcatccaggcaattctccatttcccatgagagtgtgtaagaagtctaccattggcatcatctccaatcacagcctacagcatccatcagggtattactttctctatgacagcatgtgtgcaggagggctctcacgttggaatgtggaactggcttcttgggggcattatgtatgctgtggcatttgcaccatggcactcagctcttaactctggcttcatctagatttgtttctttcattgtgacacatgggctttctttatttgtcatgaagtgtgtttctctttctgtcactcgtggtagggtttctctctttcactcaatgccacatctctgtggtctccataggtgctgtttatgtttaatttatgatgctataaagaccaataaaatgaagaactccttaagtaatattcgtgataatcctctgcctagaaataattgtttctttttagtcttaaattggtaaatatttcacagaattttagactgtaaaccttaataattaaaatttcaaggaatattcttcttagctttcaatttttcatttggaaacctcttgacaggatcattggtacaaagtacagtatttattttatagcatcactatggaggtagccaaaccttccatggctcgatctcttctttcccttacatttacatcatcatcttcatttaccttcactattgtagaaattaagtctccaatccctaatgtagcacattggtttaccaattgcatatcactatcttctgtgtcattcattagatgaaaaaaataagccttgctcaaaaatgaacctatccatgagttgtataggaacaagatttataacctcagctggctgatactatttagcaaaaacatttctccacgtagttatggtccctttgtaaaaaaaaaaaatatatatatatatatacacatatatatatatacacacaattattttacttgtgataagctttgtttttgatatctcattatcaattaaccttcataacagccttgtttggggtaaatattaatgtcatcctcattttaaagatgaggaaattgagacgcagagaggttaactatcttgccgatcataaagctagcaagtgagtggcagaaaattgtcttttcttaaataccatgctttctcctgttaagaagttgttaaaagtcattagctctgtgactagcatgtagtagtcttgtattttcacttcatccatttactttgttcaggttgattatatagtttggggtatatattttgagaagatgcacctataagatacaaaactttaattaatacaaaacgttagtagtgtgtattttcacttcatccatttactttgctcaggttgattacatagtttggggtatatactatgtgaagatacacctataagacacaaaactttaattcaagaaaatgttagacatctaacatttatggttatataatttattgtcatgtaatttattgttatgtaatttattgttatttttctcttatttagtcatttgataaatattgagctacctcctatgccttatttaattataatctgccagttatttcttggcctttggaattggctttacgtttagaatacataaaatattgtgaatgtaatgagatcagtgtctcatacagtttttcatcccttcaagcaaagtgaaaaaaaaagaactcatctttcacgtttctaactgattttcaactttgttccagcagtgttgtagcagagttcccttttcaaatcctttgaaaagattgcttcagaattcccttagtataaaccaaagccagaattaatactttcttctgacagaaactgaattccttctgacttatttgagaagctggaatatatactagatatgaatttattataatttgtaacacaatatctaacccaaagaaaattaataaacatccaagttgtcatgcttttactggtccaaattgaaccctttacagccttatctttaatgtcttagatttcccagtagcaaggttgatttagataatttgacatttagatgctaaataatttatttcctgttgactagacagggactgaaaattgtgtttttatttaatgcttaagaacttctagctacctaaaggaatgatggttttaaagttgtaacatgcaaaatagttgccctttgaactcttagacactattaggacaccaattctgatctaaacaaacttggactgcctaacagttttggagcttttgcaaacagaagtttcagttaaattgcagtgagtaagtctacatattcaagaaaagaagggagagaggaaaaaaggaagagaagaaaggtaaatgaactttaaacaccataccattttctatttcaaaagaaaaaataggaacattttttaaacaccacagaaccacaaactgtttaaactggaagaaactgtagccaaaaaataaagattctatactgtgagataatcacctaagatgttctactatataaaatctcatttagaaaatctttaataatgatttattacttatttcaatatatttatctacagtgctccaccctttcattcacatgtattatttttatgccatttgtatactatagttagaaaactggagatagtgtgaagaaatcttagaattctatcttttgaaaacactacaactgctgctattaaaatttattgattcctacctcactttcaaatttgtagaaatgaactggagtatataaattgtcttgttaaaaataaaattagtatatatctctctctctgacatacatattagtagctaatccatagagataatgggaaaacacattacattctgtttgacagggatatttgatatatccatctaattaaagcattctttaaaaagaattgagaagaattctgtctacttgggcatacatttttaaatttccataataaaaatatttttaaaacacactattgtagttggcactagcgaatttctgcttatccttgtatattgcctcatataatgatcatttacaatataaaagaggtcatcagtgaaaatagggcaagaaaaatttaaagtttaagatgagggaatattaatggatgtgtaacaagtttagaaagttcttaagctcccttaaaactaatatataaactatatgtatctttgagagagaaaggagatatgtatatcctctccttcatggaagtaggaatgaagagagtccataaagtacttatgtgaagtccagctttgtatatacacagattagcttatcatcatgatgttctaaattttctttcctatgttctagagaatttacaaatgaaatagattaattagacatatagctagttagagcccaaataaatgatggcacattataatatgatatgttataatgtcatattataatgtgatagcagtaaaatgacagctcacctgcatttatacttatagttccagctgctgtttgaatgtctttttgtaatatcaaactcagtatgtccagctctgctttctaaatacttctttcaatggtaatgttcttaaagtttccctgcatagaaatcttctagttatcttttactctttcttgtttttcatctttgacatttagtgtgacattaaattttgtcatttttgttatttctccttttgaattatctcctaatccttacttcggatacataaatgaactttgttgccacgtctactttaaaatcctggctttggccaaaaataaataaataaataaataatgaaaatggcagctttctatacattacagaggtttaagaaatgtgaagcagctcatggtcatatattgctatggttcatctccatggatttacacagatttggtttaccaccaatcctagtgtaatttttaaagactcaaataagtatcttcttgaccagcaacaaggcaaattttcttttgctccttttgggttttactcctaaacatgcatttgggtgaaatgtatagcctagactttggcaagtagaattatcaattttccctggtcaccttttttccctttcaaagcatttccttcccaaccagtgttcttcagctaagccacagaacacaggaagtaatatgtgtagctattttcttaagatcctgtaaagatgttgacattctatattcaaaaaacagaagtttattcattacacacaatgaatataaatgcattaaggcttaattctctcccagaattgaggaagatatagtaatcccatcttttaagtagctcagtacttcttgaagtcatttgttatttaaagacgcacttgaaatttcatgtttggaaattctttgtgttgcttttttttttttttttttttttttggatacctagagtctctgaatagcctgtgcttaccatgtgattttagggcttgagatcgtgagacatatttttattttttttaaataacctctttatttttctgaaagaaacagatttaatcagcttctcaccatattctaaaaatgttcctgcttggcagttattaacattttgtcggttttcttgtactgttgaagcagacttactgaagatcaatttaacatactgtttaaagtttggggctagatttgaatcctaatcctggatttgaaacccaaccctgtgccttactaactttgtgaccttaagcaagttaacttctctgcacctcatattcctgtaaaataggaatgataccaccttttggggtatcttaagtatttaacagcttaatattacttggtgcaatgcctgatatgtgtaagtactcaataaatattaactatattattatcagtatttattgttatattaaaggtccaaaggtaaagttattttttgtttcaactaactctttcagatacattatctgttaggtttttcatagagtaaaatacgttttatgtatagtgattagccacaacctgattgaaacaagtattagctccactatcaacttaacctgacatcagcacttgtaccattcctgccttacttctttttcctagtcattgtaaaggatatagaatatgaaatacatgaacacttaatgtctttcttttcattctgccaggtgactatcttctccagtttttcaattgtctttttctccaaaatcactttcccatttagtgtctggattagttatgcacataaacacaccccaaagatgactaataggaatagtggttttttattatcagtagtatattgtccttgtattctattatatgtcatacactacaagcaatcaccagtttataagtgggcaaagcacttcctcacaaaaagtaactttatagtgactagatttctagactagtgttcatataactcttaattagctgatattacactattagtaactgaattgagatttaaattgacatatatggattaatgtaggaatctatctactaattgtaacattatttcttaggaaaatgcactttaacttctaacagaatccagcctacttcaaggcattttacctgacaaattctgagttgcaatgagatctacatcctgttttcttccttggacagctcagtcttccttacagtactcattgtagtggaaggtaaagggaggaggaaactctagaaattgggacaaggacttccccacagcatcatcaatcactgtttgttgaaggagtgtatgaattgaatgtttatattaaagatgtatgccaatatcattaaatttcagttaactttatatagtgtgatattattagtcctagattacttcttgctgcctcttcctggtaaatgatgatatttctgaatgattctttattcatttgttaagtgctacttattaaataccctctgtttcttcatatcttgtaaacaagatatagatctttgagtcagcagagcaaagttaaacagatatgtgactgactgtgattaaaagaagtaatcatttctactgccgggtctgtgtcgatttaatcagatgtggtgagctataattgcatttctctttgccccagtttacccgtctctaaaatttgaataaactagacctttatgttcctcagaagggatattctggtgaaatttcagaaaatggaagggagtcatgacaaagctaattcatcatgaatgtaaaaacagaatttttcaggtacagtatgagaggaattatatcttgttatcctgtgtgcattttactttttacatgaaaattcagtcagagagccaaatatgtttagaaaacatactctgagcttaaaagaccataatggtttggatgtgctgtgtaaatgtaaaacttgaaattgatcttgttttgttatttttccttggttgtttatactttcagttttgctgaaactaccagtaggtcataataagtcagcaagcatttatttaacatctatacattgctacagagtagatattgccatattaagcatatagagaatgttgcaaaaattaaatatggggccttaatgattttacaaattgaaatattgtccattttttaaaaaatcataatgtatgaattcaggctatgttgttctaaaatatgactagaggaaatgtctttggctttgaaaactaaaggtctttactaatcgggtgaaaaaagtctgtaggaaaatcaccattcttgagtcctgtgttcacagaatagtcatgagtgagttattttaaatttcaccaaattattgttaagtcacaaaaaaagaatttggtaaaggcagattttcctagaatagacttgagtttttggaaccttattacataactttaaaatgccgtaatacctctttagaccacatttttctctatcagagatggtgtcaggttggtagtaaggcttatttaattaattttccaagttcagacatcttggaaaggagagataaaggcaaggcatgacattactctttataaacatgacttactggaggagaatgcaaattttcatcctttaaatcatttaatcggctttattgagttacctaatatatttgggtgatagaggagaccctgaaagaaagaggacctcaggaagcattataggtcagaatgagtagcatatgcacagcaaaagtagtttgtgaaagggaatttggtctttttttttttttaattcactaagttgaatttaagggcatattttgagtcttatggaatccattttaaacatagtgatagcatttcctgtgcatttttagccacttaattatgtgaataaatgcttgctaccctttacagttgcagctgtcattctccaaagtagattcatccacaatatttacagtcgtaaatcctaaatctattgtatatatttaagattttttaatagtattctttcaccattaggcagcacctccttgagaaagaatttacatttttattctcatttttaacaagaactatacagctaagatttatagagaacttgagggctttttctacaatgtactccatcatcagaagtaggctaaattagaaatagaaatggagaatatatggtgatgtcttttccattagctttgaaaaattcaacttgtatagttacatgtatttgatgtcagagtattttataagtatgcctgatttatcatactgacttgcttctttttaacttaaatattttgggaacacagactcatgtttcatttttcagtgagttattttatgtccatgaataagcgtcaatgcattggttgataagttgaaatcacctacaccctttgaatatgtgtttttgcatcactttcgaatctaccttttaaagtgaatttgacttaatttccatgtgacttttattagtagagaaagcaaataattatgaaacacagtaagggttattatataaaataattttattttacaataaaacagttggatgtggattttacctagaaagactaatattatatatatattatatttctcccttggaactgacaagggagaaaaagtaggtatattggtactcaagtgttttgtattttaagaggaaaaaaagaataaaaaaggggcaatggaaaaaagagaagagaaggaaggagaaaataaaaggaagggaggcaattaccatagtttttcttcttttttgacatcagtatttaaataataggttacttgttctaactttcccattttacatcgttgcagagcataagcagcagcttgtagaacaaaggtgaattcagaaagaccttaaacatatttttggattaatgtttcatgaaaccctgaatggaattcagattcatgtggtctttttatagccatagttttcaattatattagcaattttccttgtcctatttctgtctgcctcaggataccaaaaaaagggtctattttcgaaattttgttcataccattctgcacccagtattgcctggagtcatgaaaacccagcttgctgctattttttctctttggcaacttgctgctataccaacactcagcaattaaatctaattctgtttgggctaccatgcttaaatgttcttgttgagaatcatggcatgaactaatgcatggctctaaaaaggctactgttgtgtgtctgcactgaaggaaaaattccatagcaatctagcccctttggattttatactgaagctgtagattaatggtgaacttctgtgtaatgcttgacaaagaagggaaatccctagaaatgaaagtgtgaactgaggtaaaaatggtcttcagtcagatgctgctaaattaatcactagtaatcatcagttgtggaggttaggagtcccttcacagaatgcacttgggtggaagagtaggaaagagaaaaaaaggatgccagtgagacctgaaagagattatatgaggaaatgttgagtccatcttcatttgtgtgctgtctcaaacatttagctcagagtctgaaatacttttggtcaaattaggactgattttaattgtcttattatacaatttcacagcctcatcatccagcataaaatatatcaaaaatgacttaattccctcatatccatgacaattccaaactgtttttaataaactttataattgcctccaatattttaaaatttattaggaacactggtttcatgtttaaacaatcagcatcctttattagttcccttaagcattcatcttattttaatgtatacaatttttacttggtagaaaataaaccagatgttatttttccaagtggaaagaaatcttttttctttccttttacattacagtttcaccttgaaaatataagaagcaaatgaatggtcccaaaatttggcatttatttttctaagtcatgtttctgggctatgagttactgaattttgcttaatttattaatgtaaatacagtaattgaaccacacaactgtcagttcctccatcctttgatatgtgggctgatgaaatataaataaacaaaaaatgttgtgtgaccagcagctctggatcatctaaatgacctcctttagttcatttccctttccacatatcaagtttatctataacttcaccaatttattagttttagagccatgtagcacagttcaagagttcaaagggaaagtcaaaataatctggggttattcattcaacttcaactgctaccatatggcaaaggtctctgtagccattcttactattacaggtcaatgacagtagcatttctaaagtgctcttgtgcatgtaagtaccactccttcggtcaacctatgtcactgtgctttcacttgcaattatctaactttcagacataactgaactctatttctgatctgaaatgttccccagctagagttatctacctggcctttgctttatagagtcatatgtcctggtagctgcaaattaatgatgaatgaaaaagagggaggagtgatggaagagagagaagggagggatggagaaaataaaaaagggaggaaggaaactagactcgtttttcattccttttttacttcagcatttaaagggtaggtcacttgttctaactttcccattgtaagtagttgcagaacataagcagcagtttatagaacaaaggtgaggtagtaaaggaagtcatactgtgtatgtgctagagggaatcatactatgtcatttgctttaaaagctgtgtctgaaatcgctttggcttccttttaaacatcccacctgcaaggaggaaatatttgcaactgctcttcagattagtcgaccaggcgtggtggctcatgcctgtaatcccagcactttggaggccaaggcgggcggatcacgaggtcaggagttcaagaccagcctgaccaacatgatgaaaccccatctctactaaaaatacacaaaaaaattagttgggtgtggtggtgcgtgcctgtaatcccagctactcaggaggctgaggcaggagaattgcttgaacccgggaggtggaggttgcagtgagccgagatcgctccactgcactccagcaggtgacagagtgagacaccgtctcaaaaaaagaaaaaagaaaaaaaaaagattagtcatgatgtgggtcaaaatacctgtcttttctcttacacacatctttttttaaaatttatttatttatttatttatttaagacagggtttctctctgtcacccagcctggagtgcagtggcgcagtcttggctcactgcaacctccgccttctgggctcaagcgatcctcccacctcagcttcccagatagctgggactacaagtgcatgcccccatgcccagctaattttttgtgtttttagtagagacagggtttttgccatgttgcccaggctggtcttgaacttctgggttcaagcaatcctctcacctcagcctcccaaagtgctgggattacaggtgttagctactgtacccagccctttttaaattttataagctataccttttgattactgcctattgacttaaaagacagttccagatcaggggttatatttgtgcttttacagtctgctttatgttttgaaggttgaagtaaaaaatgtgaagagaaaaaaattgcaaacagaagaataatctaagaatccctgttccattacttattacctcatttacattaacccactttctcactgcagtttcctacactttattttttcttgtgcttcttttccctttccttgtgtgtttgtttttttcattagaaatcacctgtctctttatttctagttatttcttttcctttcctttttcaatgaaagtaataacccatttcagccactgagaaagagtatgaaccttaataattgttattaatttttgtgtttcagtgtgcttcaaaggaacaaaatgagcttggcatagctgcttttatgttctggtacactgagcctaaattctaggcaagtagctcacaggaatataggagaggtaatctggatgaaactaacataaataaattagatacaatatttctaactgtaaaaattttatgcatcatataatgaccctgtcaaaagactatttataaatagaatatgcctttttcagcttgagttaaaacataacgttaatgggtctagggttacagacttgtgaatctagttagcttcacagttgttctatggtagactgtaaactgatcccaaatgtcttaatgtagatgtgtatgcaggggaaggactgagaaacaatgattcacagggaatctatacacaattgagtaaaactgatttgaacagatagtaaaatggtctgtctatattatactaaaaggtttgaattttataattttttgatcaaatggcattttcaatgagagtttctggggttttttatttgtttcgtttctctttttgtttttttagacacccaggttggtgtgcagtggtgcaatctcagctcactgcaacctccacctcccaggttcaagcgattctcctgcctcagcctcccgagtagctgagattataggcgcacaccactgtatctggctaatttttgtatttttagtagagatggggtttcaccatgttggccagcctggtctcgaactcctgacctcaggtgatttgcccgcctcggcctcccaaagtgctgggattacagacgtgagccaccatgcccagccgtgtttttcttttagataacttttgtattgtttttcatacattcagtaaagaatatagataagcaaagagaaaattaaaattacccttcagctcctcccatgttaactgctagtaacttttatcagaaagaaataataaggatggtgaactgaagaaaagagaagagaaagtagggagttctacagataatatagagtaaatcaagaataggccgggcgcggtggctcacgcctgtaatcccagcactctgggaggctgaggagggcggatcacgaggtcaggatatcgagaccatcctggccaacacggtgaaaccctgtctctactaaaaaaatacaaaaaattagccaggtgtggtggcgggcacctgcagtcccagttactcgggaggttgaggcagaagagtggcgtgaacctgggaggcagagcttgcagtgagccgagatcatgccactgcactctagcctgggcaacagagcgagactctgtctcagaaaaaaaaaaaaaaaagaaagaaaaaaaagaataaagaaacatatgtaaaacaaagaattaccaattaaaaatttcctacatggaaaattttttaaaatttttccaagtaggaattttttaaaacatgtgggatgtaagagttggaaagctctaatggatgagtttctgcagagtttgatacaattatattgcccatatgataactgagcgatgcaagacacagcaaagccacctgaagcaaccacaggaaggaagcaagttggtcaatggtgcaactgtctaggacagtggttagaatttaatagcattctcagttcaataaatacttagtgaaggaaaaaaataatgaaaaaaatatatgggttgaaaacattgacattgtttgtttttaggatagtgtaaatgggtatttagatgatatcaaattctaaatttgagaaatccaagctaaagtgttttggggtattgaaagcctaatgtaaatgtccttgggaaaattagtttcttttttttatagttcccattatttaatgaaatgtttcaaatgttatatatagtaaacaacagataatataacaaacacccatttggtaaccatttagatttagcacattttaatgttttactatgatttattcagatcttttgatatatttttaggaaactgaacaattgtgacaaagctcaaatttcctttgcatagaattctcatataagaacaaaacagaatattaaaggcctggcacagtggcttatgcgtgtaatcccaacactttggtaggccaaggcaggagaatcacttgagtccaagagtttgtgaccagcctggacaacatagggtgaccccacctctacaaaaaaaaaaaaaattatctcggggggatgtcacatgcctatggtcccaagctactcaggaggctgaggtgggaggatcacttgagcctaggaggttgaggctgcaatgagctatgatggtactactgcactgtagcctggacagtagagtgagaccttgcctcaaaaaaaaaaaaaaaaaaaaaaagaaggaaaattaggattgtgttctttccacatatggggcatatgttgacccggcatttgaataatgctatatttcccaggatcctttttactcctctttctctctttctgcttatatttattttcaagtaacctactggtttatagtataactttaatgattttcagtgtgtgctatgaagatagaatacacagacccactaaatatgtgtgtgttgtgtgtataaatacacagattttatatatatatatgatcacttctgtttgttgtgctcagattacaataaaataaactggtcagaagcaggcaagatgtctcaaaactactctggctaatcctaaccaaaccactgtgtcatacctctatactagaaatatataggaaatcaaaaggaaccaaactggaatgcaaatgaaacaaaaatcactaacactgaaccaacgcacctcctggcattattaataacattgttctgtcccaaatgaaacttcatatactttggacatggaggttaatgattgctaaaaagagaaaatctttataattaagttttctctggtttgatggttattccatgtgatgcatctttccataaattttgagaatgcctcaacacttatagggatagatttaacagtcaggagaatactagcaagtgtagtagctatcatggatcaatagcattatgaaatcatagctttaatgcagaaatttatttatggtaaaacttcaataaacaacaaaaattgtattctgtcttttaagagatgccttcattgacttttatgaaatagcagattttttcccaaaaggtacttttgtatcccactttgctggaaccctaagtctgaacacccgtgtgtctttttattaccaatctttggcctttctgaccaattacaacagtcttctttgatgtggaagaggttacaaatatttccaggctaggagggattggggagagtaatttcagtctggatttcggtagtttgtatcatagtcattatagccattattattgtcactttcatcattaccagaaaaacatgtatttgtcctttatacaatgttggatatgataacaaatgctctacatgcattagcttattttagtctcacaataattctatgaggtggaaattcaacaaaacatttgagcctttgcacacctttagctgtttcctcagtctggaaagttcttccccatgatcttcatctggctgtctcaaatcttaactaaaatgatacttattcagagaagtcttccttgcttactcttgtctaaaatagctataccttatcactacttatttttttattccattactgtattttattttctttatagcactaaccactttctgaaactatcttatttatgtacttattagtttaggtgcttatcatctgtctactactattagaatgtaaattccaagatagcaaggtctttatcaattttgttcatgttttacctccagcacctagataagagcctggcgatggctctgggcaactgagcttagctcaacacatactcttttttattattattattattgttaatttcttttttccacatatttgttcaataattgaatagtattatcttgatttttgtagatgtggaaactaatacttgaaataatttagtcaaggttatttagctagcctaacttcctatgtttttcctgctgaaaagaggattcgctacatacacaagtctctagctttaaccgatctaattagtgcatgtctctggacctacaggtatagggcttatgttaagaaaaaaatttacatacatctgaaataatctgacctatattgctcatcctgaaaatgagttatatattatattattaaactatacttgttaactattacttggttagatcatgagaggcttgattaacaacataatgtacgccatacatagctgtaatactaggcatcagaatgcctagttcttatatatttctcgaagaaacttttctacacactttctaagctcttgctactttactagtgcagtatagacatatatttgtacatctttcatgtgccttatgaatgctagttaagcatttagaaaaataaagtcacaactttttcaatcaatctaaaatatgatttagaaaggaaaacaatacagccacactgaaatgagtaaagcattagggtttttttaatgatcaaataggtgataagacatgacatttaagaataaaaactaagaatattaaatctaattaaaaactcagtatttcaaacttcatgcttaatgaaaacgaatgtgactttcttccagaagtgtcacaaaatgcataataattacaaatactcaataattcaagtttttatattattgactgtatctattccttggcctctattttttagaattaatcaatattttctgaaaacttcctgttcacatactcacctaaattaatcttacttgatcttacttttgagaactgtcaaaatcacacacacgcaaaacaaaaaaaaatcagcatttcttattacaggcctagaatatcatccaaacaaaaggataatagtaggaacaacaatatagtaatagctaacaatatatactgttaactctgagctactctctaagcaagcactttacatgtatctctaagcaagcactttacatgtattcttattttctttacaaatatcttatgagatagatgttattattatcttcacttatacgtgaagttatgacttatacagtgttatacagctaataatggtagagccaaaattcaaatctagacagtttttttccagaatactactccccaaagttcttttgttataccattctccgtcacccctacattcaaatccctgttctcagtggttctcatcgctaagagaaacagtcaagagcaaagaagcaatgaaaattcaagttgtgattaggaatgcaatgattgtcattgttaggttagaaaggtggagtgattgatagtgtacagataattaagtttggaagtcaagagaaccaagttctattactactttactgtatgacctaaaaccagtaataattcctaccttctaacctttagaatgaagagtaattactctgtaaaataatcagttattcatcttaagattgggaaataatgaataatctgaaattcctcttagccaaaaatacttcatttagctttataatacattatataatttgggtagtaatttttcttcatatttatgatcaacattaacattttcagaacaagcaccaaaccaaaacgattgttggtaccaagaggagaccagcctgggatttgcaaagtttccagaggtcactgaacatggttcaacttggaattaaagctttatataggaaatacattaagaacatttaacattgatgcttaaattcatatttccttgagtcatggtgataaccagttctaaagaatagaaagtgtgttctacatattatagtattttctttaagaacaaataaggaactcaccaagttacctataaagaagcataaacaagctttgattttcagtggtaattataattaacttcaccagctatataacctgacacacttccgacttctttaagaatgggtcaatactgaaaaggaagtgtttttcacattaacctagaacttaggaaagctcggtggaatttaacaatgaaaatttatataacagtgggaaaacatttaagaatggtcacctggaaaagatttataaaattgttttgcttataaatattgtctatttgccggcattctcttatgttgtacatagatttaaaaaaaacagcagcccaggcgctgtggctcaagcctgtaatcacagcactttgggaggccaaggcaggcagatcatgaggtcaggagtttgagaccagcctgagtaacacagtgatacctcatctctactaaaaatacaaaaattagccaggtgtggtggcgcacacctgtagtcccagctactcgggaggctgaggcaggagagttgcttgaacctgagaggcggaggttgcagtgagccaagatcatgccactccactcgagcctggtgacagagcaagactccatttcggggaaaaaaaatacaaataaaaaataacattgctactctctatcagtgagcaataaatgactgaaaattcaaagaataaatggttatggatacatacacacgtgtgtctgtttttatgtgtgtatgtgtgtgtgtatggaagttcacctttgattagaggtttttaaatgtgattactgttaaatgattagtccatctgaaccaatgggaaaagcacaactgaagcagaattttttttaaccctgaggatttaataacttttttaagcaacagtgttccttttttgtttcttgtttcggtctattaaatgggcacttgtttaattcagtgaccaattttatataattttcttaaaaaaaggacaccttttatatctgatttgataaaagacagcaaatagaggtgggaaaggtttcatatagctataatattctgcagataaaaggaggcttggaaattatctggctcagagacttttaaccttttttctgccatggacccatgtggtacttggtcaaagcctacagatatttttttcataaaaatatttttaagtgtataaaataaaatatataacattagaaaaccaattcaaatcatgatcaaaataacttttaaaacaaactgcaatataataataaatgcctatttttaaatgcattaaataacaaactaggagcagatctaataactactataatttgaaatcattataaacataaaaagatatttataaccattgaagtaaaaggttctgttaatattactgtgatttgttgcctgagctcataatgaaagaagataataaatattaattagatttttaaatataaagattgtaatttcatttctctgtcccagtgaatggacctgtcttttacccacaagattctctcaagggacccattgacctgagttaaaacccctagaaacatccatattttgcaaataagaaaaccaagacccatagagaggagataactttactaaaatcatacaacacagaattagattaatcctagcagagctaatctcagacctttactcagactttttctgtagctttagtctagaagttggcaattcatctattatttgtcactgattcctagcatgatttgtagcaaattctttattcttattgtgcctcagattctacctatataaaatatatgtgacttaaaatattcataaagataataagaacaacttcaatttctattttatttttacttacaatagttttcactttcacatacattaccctacttaattttccccatattatggatgaggaaattaaagctctaagtgttaaatgtcacatccaaggttacacagctaggaagaggaaagtccagtattggaaatcataccatgggactccaaaggacatcctctttatcatgctgcctttcatgtcataaaaagccaaaactctttgagttcttcagttgaatatgtgctgtgatatcataaatctaattaaacacataagagctattattaaactcaaataagccaaatacttgcatcctaatttattccaaaaagtgatgcatgaatggaaccatgggaaaaaacttttctagaacaattatccatttgtgtttaagaagtaagaagagaaagaaatagaatgtaagagtctaagattgtagagttattggcttaatgttatttaaatcaaacttttgcttctgtttctgggtaggctaaagaggcaagtaatctgagtaaacgggtccctttttctccttcctcttaatcttatgagtagatggtactcaaagaagttcattctttcagagactgattactcttaaataagtttaataaggtagaaaaactaaagtcaaaataagccatgatgcatcaaaaatttctatcatctctgtcattacagtgaccagaccatgtaagatataaaacatcctgctctcttagaaaataaggaatcttcttaacctaacctgaaactcttggtatagaaaacttttattggactccaaatgtcactatttgattaaccttaagtaatattaatttctaaattcttgagatcattctgtaggatacccagatatctcttagctataatctacatacttctcatattatctgtcaatactatcagacccaaataagtaaaacttctttgtaagctgataaaacaggtacaggaatggctatgatcatacttatactattaaaaataaattttagtctgctgagattgaaaagaaaaataattactacaaaatattcagatttagcaaatgtttcctctgtacaaagcagtgtatttaatgtagtgggaaataaaaagaggataaagtcatgatccttttcctctaagaacctgcagtctacttggggactcatatcagtaattggaatatgagtaactattaactcctattctatattataaacttctataagtcctatattagaatttcaaataagatgccgtaagaatctaggcaaatctaaacctaggttgtagtgttggttgcacagccatataactttattaaaagtcatcaaacttttaatacttttatacttaaaatgaatgagttttatggtagataaattatatctcaacactgctaaaagagtttagagaaagaagaaattatttctgattgaggaacttgggaatttttttttaatggctggtgtaatctaagctggatcttaaaggacaagtagtatttgcatcagaaaataagcaacagtgtattccagataaaggcaacagcttgtctaaggtctaaaagttcaagaatacaaggcagtttctagaggagctggttgagactttgctccatgccttagattatatggcttgcatgcctaccgtgcatatggccatatggctatgacatttccaaaatgttctggcgtatccctactgagaaacgtataactgtacatagaattttccacctctctttgggttagaaacaagagcttgcctacattataatgaggagggtgtgtaatcacagagttattttacagctgtcagtggcaccactgatcataacaactactgacatttattttcatttttatagcttaaaatcactgatgaatgcattatctcctttgagccacaatctttattttttttctgtgaggaaactgagattatgggagggcccagagcctaaaataccaaagccacattaaagggaaagtcaagatattctggcctgctaagagtaaaaagaggaagagaaaatgagtacatgatcattgaacagtttagacattgctaactaaattgggatgtacacatgaatcaaagttcatctcacacaaaaagaataaaatggataaagttaactactgtcaccaataatatgaaagcaaagttgaattttttcctgaagagctgaaataagcctattattgacaggaatagcccattttaaataccttgtattgataacagagaagagtacttaggaaacagtttctaaatagcttttttgttgtttgcttttttaacaatgtaaaaagattaaaatttaaattgtgtctttccaaaacagaggacttctcagattatataagtaagcagctaaacagaaacttaatttctaatttaaaatgtgattagtggccagtaaagtcatgtttaaaatggaaagatagttttcctaatgtccttcaaagaagatgacttattttgttcttgactttgaccccatctgaccaagtgctcagaatttttcaatatgaaccatactgtataccatttacaagaaaaggaatacaaattagcctggtgagcagcaaaataggcaattttttgaaatcggatttgtgttaacctgcaatcaaatgtaatttccattttaatacttatacattcttatattgttatgaacctattcttaacacgggttttattttctttgtttctctcctccctcacttctgtgaaatacagaagggaaaggatgttattcacacatttgtacccccactaactggtgttacagtacatctggcttccactggagagcccctgacatcgcagggaacggtgatcaaaattccacacactagcttcaagctgggggctcgtagctactgcagcattgaaagggaatcttttcctggcttctttaaaataagcatggtgatgggatggtttaagggaagaacacctctcaaatcacatgaccactgctacgctttcgtgtgtcctgctttcttcataacagcttggcactacattctttccctgtatcttaatgggcttgtgtgtgtacaagtggggtggagggtggggaggtaaatggatggttatacattatgcatgcatctttcactgttaaagcaatgtgccttcccttatatgtcacaaattatggtcacagattaaatcttctgtgtcttgagatattgggccatctctctctttttggtgtgagattcatgtgtttgggtgtgttttgatgtttacaccctcaattgttcttcatgttgcatttaacgtaagttgaaatgttctcccataagagttagcttttcatgttgggctgaaaaagtcttcatttctgtgtagcaattcatgttattataacctatggctttcaattgtacctcccataatgaagagctgactttaaacactgtgctattcttgttatgacctaagcataaggtaagtgatttctctaactgtatctaaagattgttgttgtttgttaaaatttcttcgctttttttaaggcattttcacttttgttccttacatttattatgtgctctcccttctgtttttctgtttcacatcttaagatttcctaatggacgatgtgatcttcagcaaaaattatattacacatgtaaacacatgttgaaatgaattatttgatgtctcaaaacaatcttgattagtaaatgaatataccctatgttttcattaagtccttcatgttttttattttctccattgactttaatataatatgctgttcctacatgttattttagttttgattccagttgaaaggggaattatttgtcaatactgtaaagtcagatgttaactgaagtaaaataacatgatccagtagaataaagtagaaggtaatcagatgccataccttttatttgtaatccctgacaaatttaacgttaggccaaaaactgttttattttgctttccagactttcctttttttcccatagagtaaagccagggtaacataaagaaaaaaacgagaagccataaaacttgagacagatctgtgttaccttctttatagtccataagaacagtagttgtttctcaagtgtatcatttcaagtgtatgccattacattgtgagttaagtaaaattttcattttgaaattgtataaaattaagtacatattataaagagaactagtttcatggtgcaagagaaaaagttatttgctacatgcataaataataaacaacatttttaaatttttcttttcttcagtggtgtataggttgattgattgattgatttatacacacacacatactcaagatcactaaaggaattcttataatcattgatattaaagtgattctccccaaatctggttcaaatagccaatgtaatataaatgggaaagcattgattatactgctgttggcaatttatgaaccttgataaacgctcagattcagggaattgaattgttttcatcatccaaatttctccaccaaagctgtttgaaatatgtagttctaaactgaggtgccacaaagcaacacttgggtttctttattcaattcatgttatgaatgattttgcttgttaattttttaagttacctagggaacgggagagggtattttgttgttgttttggtttggtttgggtttttttggtaaagccaactagttcttcaccaccatttccattatatacattagaaaatgtatataagaggcattatataaatctgttggaacattttatgagacaatttgaactactcatctgaactgctctgttcattgtaaatctcttgtttctatccatacactagctccactctagattggaagggcttaaagatgaactctggaggaatagaggctacgacttaagagtaactattactgatcaaaggagccactttccattcgcaaacattgctttgcgctatgggtttgggctccttctgtttctacatcttgttgaatgaagactttcttgacttccatttgacttctttgaactctgtttttgtcttttaacatttccccctttcttttccttctctctcccagatttttctctcactcttctagctttctcttgtgttctttgaatcactttttgaaatgtagtttctctctttattaagcttgtctattgtctgttagtgtgtgtttcttttctttaaggctgtagtggtatagttacacttatgttcattccatagtatagcaacttgcttatttattttgcagcaagttcattagtcattcttaccctcttggtatgaatttttaatgagaaatagcagaacattctgcatttacatattgtccccttctgtaattccatactttattttccattgtttagatttacaccctcaaacctctctctcttttcttttcctcattcttgtgtcttcttccctgtattattttctttaagcagtcattgatttatttcccatttggtccagaattgtacttaaataagacttctgagtaaaagaatataagaatattatcttcagactagctttttccttctagtatgtttaaaactagttgaacaatctgggccaaaagagaataactaacatttggaattatttttccttttttttttttttttttttttttttggtgtgtgtgtgtgtgtgtgtgtgtgtgtgtgtgtgtgtatttttcttgtatgtatgtttgtgacttttttattgccgtttttttaaacattaacaattgtttttttcagggaaggacaaccataacccaccctaagttgcaacattcctttcataagttgtttcattatgatagtagattgtgttgaactatagaaattaatttgttgtgtatatatccatttgtggcaagctgctgtggaatgggaagcagaggtctggagcttaaatacagtttcttttgaaattaacaacatgttaatgacatgtaccatgctccttgaatgtaacagttttatcacatttaaaagaatgtttcacattgacttaaacatttgagtcaaagcataagggtttctgattgataaattctatatacacctaagaactggtaaataaatttgttcaatttcattgattttcaacagaagcatatttcataatcaatattataactatgataaattatgataatcagtaacaggttatcagaatcaaatgtaaatgttatataaggatcaataagtaacaggttatcagaatcaaatgtaaatgttatataaggatttctctattttcctcccattaatttatatacatactaaaaaattactataatggaatacttagttacaacttaattacttgaattttattattattctagtcaagagatatactgaatgccttactattaagggccaatatttacaactaaatatacagtaacaaatttccatataccgattttaaatacaaatgaataaaaaatcacctttggtttatctctgtgtaatttacaatattgtaccccgaatttttttctggaagtcagttctttctttaaggaaaagataaagaaaaaagatgaaacaagtataacatttttactaacatgttatgacatctgaaatactaatatataaagcctttgctcctagacctcaggagcttgcccattaaatatgcatatctgcctattcatgctataaaccctaaattactgagtttatgctctttctacaggtccagtccaggtgcagcagcaaggagaacattctcagagccagtaagtattttaccatttctggtgggctgctgaactagagcttataaagctaaaaatgatattttggtgaaaaaaaagaagaaaagcaatggggaatatttatgtgacaaatatgaatattagggcttttaccttctaaaaatattgccagtatcaatacattaataaatatttcccttaatctaattgtttttgcaagctgacaccagaactttgatgcactcctaggagggtaggaatgagctcctctgtgactctgaacctctctttaattgttccactgccaaaagttatttgaaaacaaactaactgaaaataataataataatattgaaaattcctgaacagagactaattctgaaaaaagaatatgtggctcccaagagggtacatcatactcattttgtgaatatgaattcctgacatataataacttcacaggcagcatgtgttagaacatagaaccttaaaccaagagtaaagaatgctcaatttatttattggtttgatcactaatagcattaactcaggagtcatttaactctgtatatcattcatttttctgtcttataaaaaggaactataataggttttccttatctgtacctttgaaatgatgtcacattgaaaatcgtgtcttaaaagatttgggatcctaagaaaaaagtgctatataaatgctaatggttttattattgttctctatatcttaatagcttaatgacatcattccatcttcttcctgatctttatcaagagaagtacaggggaatcatactgaaataggcctactgatactcataccactgggagttttagcaaattgaatgatttctatttctagcagtatgtcagcattatttttgtgttatactcctggttatgctttattacagtgaaaggatacagattaacatcagcaaaggcaaaaagatacatagggcagagtccaggagaaaccaggtgcaagcttccagttgccctctcccagtggagccatatggacattgcttatttctcccagcagcaatgtatgacagcatgcatcaagtattgccaaccagggaagctcactgagccttaatgttcagggtttttattggggttgggtcacatggccatggagtgctcatgtggctgatctttatttcacaataaaaaaatagagaccttcacaaaggtaaaaattcatggggtttttttgtgtaaatttttccatttttgttttgtaaatctgttatcttagctccaaacccttgggcaaacacaattattgcttgcccaagaccattatattggcaaggcgcagtggctcacacctcaaaaaaataaattcctctgagcccctttgaacctccaatttagggtatggggagtgtttccaattgttacagtgagataagtctcgcattagattgcactttgatttcttttctttgagctccctagttgccaactttattttgtgtcctaggagtaaggaatcctttttaggactcctttgataatctaactaaatttgaaaatgcatttatccttggtaaaaatctgtcttattaccaataacactactatttgtctctgtctgtccttgtcattttttgttgtatctctgtaaggggtacgttcataaggaaaaacatagacataggcctcagtaagtattttgcaagctggccctgaaaaccaagtttcaggtttcttgtaagactggtgtcctttagataaactttaccctggtcattgatcaacctatgagaaccttccttgttctctttctgttttgttagtgagagtcttgctatggaagaattataataggcaccctgaggaatttttgatatgaacaaaattgtttatttaaaaggagcctgagaataaaaaggaaacaaaattgcaaacaactaatgagctagttttttattggtttgaggaaatatcccaaataaattgagattccaaaagtacttccataagaaattccttggccaaggcaaaataaaatgtaataaacttaaaataatgcctcttttatatccctcaaaaccaaatcttggccctaattaagaagatacctgggtctcactggctatagcaggcaatgagtttgcaacttttctgaaattgccatgccattatatgacttaaccaagtccttagaaactgaacctctttcgtggccaccaaatgtgaacaagctctcacaaccccttgccttgctatatccatcaatcccaaatgattacatcaggatctttatccaatcttaatgaagctcctatattgaaagatctactttggaccaaacttcaaaatctcataaatatcctgactttcctttctgtgactctgactctaagactaagtctttgttgaagtgacatttttcctttctagagtcaaactccctatattaaaatctcaatttctctacttatttgctgtgtgaacttgaacaagtgctcagtatctctatgcctcactttcctgatctgtaaaatgtggtaataacttgttcagaaagggcagaaattgtaaagaataaaataaataaattttaaaatgtggtaataagatggtctgccttatagattgttacaaggattaaatagtataatgctaggtacataataatcactcagtaaatgttagctgatattattgttactattactactaatactaccaattaccattattttcttgataatgatgatgataataaaataggttactttttattgaacgttactgtgtattaaatacttttctacatggttcatcccacttaatcctcacacacaacaacaaatcctgtgagtaaaattctattaatttctacattaaatagataaggaaattaaagattccagagttaaataagttgcttgtgtatatggtaaatggtatatgagttgaagccagtatttcagaccttgattttatagcccacatttttttttgtttgtttgttttgttttgtttttgagacggagtcccgctgtcgcccaggttggagtgcagtggcgcgatctcggctcactgcaggctccgcctcccgggttcacgccattctcctgcctcagccttttgagtagctgggactacaggtgcccgccacctcgcccggctaattttttgtatttttagtagagatggggtttcaccgtgttagccaggatggtctcgatctcctgacctcgtgatccgcccacctcggcctcccagagtgctgggattacaggcgtgagccaccgcgcccagccttatagcccacatttttaaccaacatgctgtgctacctaattaatttcaataaggccttcaaaacccgattcaatattgtgcaaaatatctaagcaataggtaagaatagaaattgatagctggtatatccgtgggtacttataaacaaatatctgattatcagtgccaaaattgttttattaccacgtgttatcaggatgatatgacactattgtcttctgtcatctttccacctataattcatttccgtcaaccactttatttttaataaagcaaacttttgttatttttacgaataactggttttatgcaagaaatcaagtaaaataaaaaaattttacagatgagaatttatatttcagcactgtaggacagcgttttaatagctttctttctgccccaccccgagacaaagtcttgctctgtcacccaggatggaatgcagtggcacgatctctgctcactgcaacctccacctcccaggttcaagtgattctcctgcctcagcctcctgagtagctgggactacaggcttgtgccaccatgcccagctaatttttgtatttttagtagagacagggtttcactatgttgcccaggctggaacttgaactcctgacctcgtgatcagctgcctcagcctcccaaagtgctaagattacaggcatgagccacggtgcccagccttaattgttttcttgatgtactttgttcagcctgtgttttatcggacaagtggtacattttcctgggattaacttttctagatttttttagtatattttaatggaattcagaatttttattgatatataatatttgtacatatttatggagtacaggtgatatcttgatacatgcatagaatttgtaatgatcaagtcagggtatttgggatatccatcacctcttgagcatttatcatttcttcatgttgggaacatttcaaatcctatattatagttattttgaaatatacaatacattgatgttaactatagtcaccctactgtactatcaaatattagaacttattcattctatataactgtatgtttgtaccttttagccaacttttctttatcccccacaccatccttcccagcctctgataatatcactctgctcactgcctcagtgaggtcaacttttttaactcccacagattaatgagaacttgcaacatctgtcattctgtgcctatcttactttcacttaacatgccttccagttccatctgtgttgctgcaaatgacagaatttctactattttaaatagtagtccattgtgtgtatataccacattttctttatccagttatttattgatggacacagtttaattctatatcttggctatggtgaacagtgcttcagtaatcatgggggtacaggcatctcttttgatatgctgatttcctttcctttggatatataccaatatagcagaattgctgagttatatggtagttctatttgtagttttttgagggagtccatagtgttttttataatgtcttactaatttacattcccaccaacagtgtataagagttcccttttctccacatccttaccagtatgtgttagtttttgtttttttatagtagccattctaactggagccggattatatttcattatggttttgatttgcatttctctgatgattagtgattttgggcattttttcatatacctattggccataggtatgtcctcttttgagagatgtctattcagctaatttgattactttttaatggaattatttgggtttttgctgtttagttgtttgaattccttgtatgttgtggatattagtcccttgtctgatgaacagtttgcaagtattttcttccatgttgcaggttgactctactctgttgattgtttcttttgctgtgcagaagcttttcagtttgatatagtctcatttgtctgtttttcttttgttgtctgtacttttgaagtcttagccaaaaaatatttgcctataccagtgtcctaaagtgtttcttctgtgttttcgtctagcagttttatagttctcgttcttatgtttaagtatttaatctattttcaggtgatttttgtatataataaaagataggcgtctaatttcatttttctgcatatggctatccagttttcccagcaccatttactgaggaagacaccttttctctgatgcatgttcctgatgcctttgtcaaaagttagttggttccctattctgtttcattgatctatatgtctggctttatacaaataccatgctgttttgcgtactacagctttgtagctgctattgttacaattactactagtactactagtactactagtaatactatgattagtatactggtggtacttctggtattatcattattctttttttttttttttgagatggaattttgctcttgttgcccaggctggtgtgcaatggcacagtcttggctcactgcaacctctacttcccggattcaagtgattctcctgcctcagcctcccaagtagctgggattacaggcatgcgccaccacacccagctaatttcgtatttttagtagagatgggatttcaccatgttggccaggctggtcttgaactcctgacctcaggtgatccacccgcctcagccccccaaagtgctgggattacaggcgtgagccactgcgcccagccttatcattattctttagcgtaaaggcactgtcttaaaagatctactcatttagtgaagatacattaactagttggaataacaaattaagctttaaaatacactagtcttacgtaaatttatcagataatttggctgccacctctgagagcagagttttaagaaaatggatgcatttaggactatgattagggtataagaggaagggaaagcctaaaggaaggcatgtcaagcttgggtacctttataaatcactccctccttaatgaagtaattatctttcttggcacttctgtctcctagtgttccttttaaactatctgtttgcattttctccagcttctttggtagctctttttttttttttttttggcccagtcattaattatcagtattattcagacttctctcatagatcttccattcacactctatattatgcatgagcaagaccatctattaacaagtctttcaagtaaaccaaatctataactccaatccatatcttcttcctaaacttcagttttttttccaattgtctgttgtagatcttttcttaaatattacacaagtatctcatactcaacgtgactaaaactaaatttatcatcttaatttactcttcttccatatttcaaggagtaacatcactagccactgatttgtccaaaccagaaatctttagtgtttattattcctcatcctacaagcatttttatcattctaaaatacaaatctaaacctatcatactcctttaataacattaacccttaaatggctccttattattcttgtgtaaaggcccaactccttaaaattgcttactattggcttctgcttatctctagttttacctggaattcagtgcaccagccatatgaacatttcaatttgcaaatagttccctctttcccaaaatgctgatttctcatttcttccaaaacctggataactcctacttatcctacagttctttcaggaagccttctatcacctcccaaatctgagcaaagtgcccctcccaagttcttttctagtatactgtagtttccctactttattgcaagagtatttacagtgtagtgcttttctgtcttctccactgtcctctctactccaccctaagcatcttgcaagacctcatctatcttgttccctgataccattaccagaatctatcaccatgactctctctcaataagagttgattggatgactgcataaataaatgagaggaagaccttaagcagacagagcaagcaaaagacagcagaattgctaaataagaaaccagtatgggaacagaaaaggaaaataatgaacattagcaaaaactctaatatatttattgaaaatactgggggttttgtttgtttgtttgtttgtttgtttgtttgtttgttttaactgctccttctcttcaaattatctcatgtatccactttggcccttatcccttcattcattctcactactgccacccaggttctcgacttattactacctcttgcctggagtgtaagtcagacttttcagtcttataccccttaatttgtcatagatggataggtcttctggttagttttcttgcatcttactattaagaaacatgaatttttatcttttttattattcccaggaaagaggattttgaaataatccttggagaagtatgttaatttcttatgcctcctatttttagaaaaaaatttctgtttatctcttgctgcaacctaatcccttatcatcttgattggcattcactggatctgacaatagctgcttaccatcacttagattacctttctttatataactaaggataattagcaattgacttccataaatatttattgaggtactatttataagcactatttttctcgacttttttatctagtctaagtaaaccaacttattcaattttccttgctatatccttatgtagtttatttactaggttctcgaaatttaaaaagaaaaaaatattttagagattgtatctcactatgttgcccagactggatttgaactcctgggctcaagcaatcctcctgcctcaatctcctgagtagccatcatgcctggctttcaaatataatttttttatttgtgaaacctatattcccaaagtactattcgctattcaatttaaattttgtcttatttctcttatttttctcggttatcacctttttattttatatgaaaagttgcatcattcattactttgagtcaggctttttaccttcctcgttgtcaacattatagcaggtattgctaagaaacattaagttaatagataggaagccccaaccctcatatcctcatagagacaccaacttaaaagcaatatatggtcataatagcttcatgaaaactccagaaaaaaggttgttgcaatacccccaagctggcacaaagccaagaatagccacattgaaatggataagaactgttttactttacctgtgatagtccctcctccaagtcagcatagcttagcatgataaagagaaaacaccctactcatggtttctttctgtgggggaagagtggaaacatacatccaatattctagcttttcagaggactgcccaaataactgccttctatctcactgcattgatggaactaccacagtttgaatgcctgagggctactgaaagccagggagagtggaggcagcttgctgtagtaccacagggcctacagtgccacacacaggcaccagcacctctcagtgcaatctggagaaagtgcccaattcttgacttttcactcaggagggagagagaagagtggaacatgcattaggtgttctgactttttggagggctaccaagagaatggtttctctgttgcctcactggggtggtaacagagagctggtgtactttggatgtctgcgggccactgagaataaggaacagtgatggcttgctacagcagcaccacagagcctccagtgctgcagacagacaccattgagagcaagagattgcaagctcctgacagagaaacctgcaaacctctctaattgggaaattacatacacagacccagagaagtcacattcccccgctttcaaaaaggtttcagaggccgcctcagaatttctagccaggttgattggtgagagtgtcccctatataaggccagtctgtaaagattgggagacatggctgtttctcaaatgactaaaactcagcaaaaaatcacaaagcacaccaagaaatcaggatacatgcccaatcaaaagatcaaagtaattatctagaaaccaacctcaaagaaacagagatttatgattacctggcaaataattcaaaataattacctttaaaaaggtcactgatctaagagagaacacaaatggacaactaaacaaaatcaggaaaccaatgaatggacaaaatgaagatttcaacacaaagttagaaactattaaaaaagaaccaaagagaaattctggagccaaaggatacaataactgaattgaaaaactcactagaggggttcaacaattacttgaccaatcagaagagatcaacagcaaaattggaagacaggtcatttgaaattattgttagaggagcaaaaagaaaaaaaaggaacagaaaagtaaagcaaagaaagccaaagaggccaggagtggtggttcacacctgtaatcccaacactttgggaggccaaggcaggcggatcacttgagtccagggattcgagactagcctggccaacatggtgaaaccccatctctactaaaaataaaaaaagtagccaggcctggtggtgcacacctgtaatcccagctactcaggaggctgaggcaaaagaatcgcttgaacccaggaggtggaagtttcagtgagccaagattacaccactgcactccaccctaggcaacagagtgagaccctgactcaaaaaaaaaaagaatgccaaaaagatttataaaatgccattttgtggaccagtgtatacattatgagagttccaggagaaaagggacaccaaacttatttgaagaaataatggtcaaaaacttcccaaatttgatgaaagaaatgtacatccagacacttgaagttcaaaggatataactaaggtgaatccaaagaggcccacactaagacatgttataatgaaactgtcaaaaatcaagggcaaagagaaaatttgaaaggagcaagagaaaagtaactcatcatgtacaatgaagttcccataagaatgtcattggataaaccttacaggtcagaagggagcagtacgttatattcaaagtgctgaaggaacaaaatctgccagtgaggaatactgcatccagcaaaactgtcctttcaaaaatgaaaaaagaaagactttcccgggcaaacaaaacctaagggagttcatcacaactagacctggcttacaagaaatgctaaagagagtcctgcaagttgacatgaaaggactctagacaacaacatgaaagtttatgaaaaacacaaagctcactggtaaaggaaaatatatatatatacaaattcagaatactatattactataatggtggcatgtaaatcacatgtaacactgtggggatggaaaatgtaaatgagtagacttttatatatgattgatagattgttctgtttcatgtaagtctcatggtaattacaaagaaaatgcttatagaagatacagaaaagaaaatgagaaagtaatcaaagcatatcgataatgcaaaggaagacagcaagagggaaaaagagggactaaatagctacaagacggacagaaaacaacatgtgccaataataaggcctttaagtgtaattggattaaactccccagtaaaaagacaaagtgaattaatggattaaagaaacaagatgcaattatattctgtctacaagagactcatgctagatgtaaagacacatataggctgaaaatgaaaggacagaaaaagatattacttcatgcaaattataatcaaaagagagcagtggtggccatagttatatcagacaaaatatagactttaggttaaaagctgtcacaagagacaaagaagaatattatactgaaagaacagaaatatataacaattataaattaaaatccagctaacattagagcacccaaatataagaagtaaacattgacaggcgtgaagggagaatagacaataacacaataatggtaggagatttcaatattctactttggataatggatagaacaaccaaaaagattaataaggaaacagagaacttgaacactgttgaccaattagatctaacagaatattccacccaacaatagtaaaatacacattctttcctagcatacatggaatattctgtaggatagaccacatattaggctaaaaaacaagtcttaacaaagttaggaagactgaaacctatgagatcttagtggactgaaactagacatcaatagcagtaggaaaactggaagatacacaaatatgtgaaaattaaatgagacactcttgaacaaccagtaggtcaaaggaaaaaaaaatgagagaaattagaaatatcttgaggcaaaaacacaacacaccaaaacttatgaattgcagcaaaagcaatactaagagagaagtttatattagtggcatgtactttaatgagggggaaagacctcaaatcagcaacctaactttttacctcaaggaatgagaaatagaataaactaaatcaaaagttaggagaaagaaggaaataataaagatcagagcagaaataaacaaaatagagaataaaaatactaggaaaaaaagcaatgaaactaagagtaggattctctaaaataccaacaaaattgacaaactcttagctagacagacagaagactcaaaataactaaaatcagaaataaaaggagacattgcaactgatgcttcggaaatagagatgataagagactgctatatacaattatatgccaacaaattgaatcacctagaagaagtggataaattcctagaaacacaaccttggtgttcagtcacagtcttggtgactgaattatggagaaatagaaaatctaaacatatctataaccattaaggatattgaatcagtaatcaaaaacctccccataaagaaaacctcccaataaagtaaaacccatgaccagatggcttcactagagaattctaccaagcatttaaagaagaattggtaccagttcttctcaaaatattccaaacacttgaagaagaaggaatacttccaaaataaatttattaggcaacattaccctgatacgaatagaaaaaatacaacaataaaaaagataactgataaaaaaaattgatgcaaaaatcctcaacaaaatactaggaaaccaaattggattatacacttcagccatgtgggatttatccctggaatgcaaggatcattcaatgcatgaaaatcaataaatgtaatgtatcacattaacagaacatggaatgaaaatcacatgatcatctcaaaaggtgcagaaaatgcattttagaaaattcagcaacctttcgtgatataacaatcagcaaactagaaacagaaggaaattacctcaatataataaaggtcatttatgaaaagctcataacataacatactaaatggtgaaaaactggaagctttttttttttaagatcaagaacaaagcaaagatgctcatttttgccacttctttttagtataatactggaagttctaatcaaagcagctaggcaatgaaaagaaagaaaatgcatcccaaatggaaagaaagaagtaaaattatctctgtttccagatgacatgatcttatgtagaaaactctgaaaattccacttatatacatacatgcacacacacacacacacacacacacacacacacacacacagagaaacactaactgttaaagctaatacaagaagccagtaaaattgcaggggtacaaagtcaacaataaaaaatcaattgcatttttatacactaacagtgaatgattaacaatctgaaaaagaaattaagaaaatcccatttacaatagcatcagaaagaataaaatacttaggaataaacttaatggagaaaatgaaagacttgtgcagtgaaaaccacaaatcattgctgaataaagttaaagacacagtaaatggaaagatacctggattcatggatggaaagacacaatattgttaaaatatccatactacccaaaggaatctacaaattcaaggcaatccctatcaaaataccactgacattttttatagaaatagaaagtaccaccctaaaattcatatagaatttcagaggtcctgggacaaccaaaataatcttgaaaaagaagaacaaagctggaagtcttacatctcttgatttcaaaacatattacaaagttacagtaatcaaaaaagtctggaactggcataaagacagacatataaactaatgtaacagaatatagagcccagaaatacatgttcgtgtatatggtcaaatgatctttgaagatggtgccaagaccattcaatggggaaagggcagtctcttcaataaacgttgttgggaaaacagctattctctttgcaaaagaacgaagacagacccttatcttataccatgcacaaaaattacctcaaaatggattaaagatctaatagttaagtctaataggtaagacctgaaactatgaaactcacagaaggaaatatgcagaaaaactttatgacattgaaatgggaaacgatctcttggatatgataccaaaaagcacagacaacttatacaaatgtagacaaatgagactacctcaaatttaaatattttctgcatcaaaggaaacaatcagcagagtaaaatggcaacaacagaatgggaaaaaataattgcaaatcatatatctgataaggggttaatatccagaatatataaagaacccctacaactcagcaacaaaaaaaatcaaatatcccaatttaaaaatggggaaaggacttgaatagacataactcaaagaagatatacaaatggccaacacacatatgaaaagctgctcaatgtcactaatcatcagggaaatacaaatttaaatcacagtgagataccacctaacaccattaggatgactactaaaaaaaaaaaaaaatagaaaataacaagtattggtgatcatagggagaaattggaacccttgtgccctgttggtaggtttgtgaaatgttgcagctgctacagaaaatagtatggcgtttcttcaaaaaattaaaaatagaactttcatatgatctgtcagtctcacttctgggtatatatccaaaagaattgaaaatagcatctcaaaaaactacttacacacctgtgttcatcacagcattatctacaatagccaagatatgaaagtaatcttaatgttcattaacagatgaggggataggcaaaatatggtctatttatacaatgaaatattattgagcctccaaaaaataaggaaatcctgtcatatgctacaacatggatgaaccttcaggacataatgctaagtgaaataaactaatcaccaaaaactaatacttcatggttctacttatatgagacatctaaagtaattgaactcatagaaagtagaatggtggttgccaggggctgggaggagagggaaatagggaattagccaatggatgtaaagcttcattcacacaaaatgagaaagttctagcaatcagttgtacaataatatgcatatattgttaattctgttaaattttttaacataaatacttaaaaattgtttaagagggttacaaaatgtatatagattaagcatctggaaaatgtattaaaaagttaagttaatcattgatcatagaattatcctggaatggacatatattgtccttcagtgtctcttttttgtgatgtgtatatgttaccattctatgtgtaacaagtgaattactgattctcattattagattcaccacctacataccaatggctttctattttaagcctgacttctcttccaagctccagattctccttgctgttgtgtactggaatcaccctttgatgtcctgctggcatctcacatttctttcatcagaaaccagatttaggatcctttcctccaaattattcctgtattgttcttttatacaattacactcccacttactctaataactaaatttgaaatctcctcatgatattaccatctccttctcaaagcatagtcagtcagtcatggaaccctctgctgcagctcttctaaatatcctttttcccattcttgttgtaatagttcaggccttctgcatcattctcctttgggattgcagtagcataataattgctcttcctatcttcagtctcttgctccctgacagtcttccatcagtcaagtattacattttaaagtacatactacttttctactgaaaatcttgaatagttctccattttccatagtactaagcctccagaatttgtcctgaactgaattgaccagccttataccttatatttcatcctcttcacctccaacctccagcttcattgggcaatttcgcattctctaaaagtactttcagatctttgtaattttgttcatattttctccagtttcatatgttcttctcccttttctcattgtttaaagatcccccctgtaaagccttatagtttgtcccatcagaattagctgttgctttttctttgttatcttacatagtgttttgtttgtactttaaaacataagcatacacatagtctgttattttttccttaaaacacagcctgatttgtgtgttccttgaaagactgtgtaagataggaatctcatctggtttatttcaacatactcccaggccaggtgcagtggcttgtgcctgtaatcccagcactttgggaggccaaggcaggaggatcacttgagcccaggagttcaagaccagtctgggcaatatagtgagatctcatctctatcaaaaattaaaaaattagttggatgtggtggcacatgctgtagtctcagctactcaggaggctgaggtgggaggattccttgagcccaggaggtggaggttacagtgagctgagatcaagccactgcattccagcctgggcaacagagcaagaccctgtctcaaaacaaaacaaaacctcactcactgtgtttaacaaagtgccctatattgaccagaataaagtttgaagttgtaagtagtgtttgcttatctatacaaccgttctactttgtcagtctatataatctagactgtactgtgtgcataacatctttggaccttgatgttaaggcctttttttcttcctcaaagaggtgataatctagttaagaaaatggacatgtatataaataagtataattactgtgagatatgtggttaatataatatgcaattagaagtcctaaaaattgagtattttatagtacctcagtgcaaaaatagacatacgtgcattgtttcagaaaggagagactattgatgaaagtgatttttgaaattttgaaataatttcaaacttcagaaatgttacaagaatagtatagagaattcctgtatatctttcatccagactcccccaaatgttaacattttgtcacatttcctttatcatttctctctataaattaatatacatattatcccaaactacttgtgagtaaattgcagacatgatgcctctttacccctaaataatttaatgtgtatttccttccaaaaaaatctggagggatggcaaataaaaaagactttctcttacataaccacagtacaattatgaaaattaggaaatgaacattgccacaatactattatgtaatcttattcaaattacattttgtcagtttttctaataatgttctttataacaaaggagacaacattcttctgatctgggattcaatccagaatcatgcgttacatttagttatcctgtctctgtagactcctttaatatggaacaagtcttcaagtttgtctttgtctttcattacctttatatttttgaagcatatagctcagttattttgtacaatgtccctcaaatttatatttttctcaggtttcttaatggtttaattcttgttatacatttggtcaggaatatctcaaatgtgatgttgtatctttctcagtgcatcttatcagggggctcatgatgtcagtttatcctattactggtgatattaactttgatcacttggctaaaagggtgtctgcgagatttctccactgtagttaatgagtacagttaataaatatcttgtagggatatactttgagaccagacaaatatgttttgtttttcttgaggcttttaccttctagtcttagcattaactgattatttttccctaaaccaattattactagatggttgccaagtggtgattttctaattccaatatttcttcatgtaacagctgaccttctgttataaggaagaatttattctcaggccagcatattttcaaaatgagaaaggcatcatagctctactttgggccttattggtatttgcccaaaatacaaacactttctttttttttattttttttattatactttaagttctggggtacatgtgtagaaggtgcactttttttacataggtatacacgtgccatggtggtttgctgcacccattaacccatcacctacattaggtatttctcctaatgttatccctcccctaaccccccaccccccaacaggccctggtgtgtgatgttccccttcctgtgtccatgtgttctcattgttcaactcccacttaggagtgagaacatgtactgtttggttttctgatattgtgatagtttgctgagaatgatggtctccatcttcatccatgtctctgcaaaggacatgaactcatccatttttatggctgtatagtattccatggtgtatatgtgccacattttcttaatccagtgtatcattgatggacatctgggttggttccaagtctttgctattgtgaatagtgccacaataaacatatgtgtgcatgtgtctttaccatagaatgatttataatcctttggatatatgcccagtaatgggattgctgggtcaaatggtatttctaattctagatctttgatgaatcgccacactgtcttccacaatggttgaactaatttacactcccactaacagtgtaaatgtgttcctattcttccacaacctctccagcatctgttgtttcctgacgttttaatgatctccaacctaactggtatgagatggtatctcattgttgttttgatttgcatttctctaatgaccagtggtgatgagcatattttcatatgcctgttggctgcataaatgtcttcttttgagaagtgtctgttcatgtactttgcccattttttgatgggtttttttttttcttgtaaatttgtttgagttctttgtggattctggatattagccctttgtcagatgagtagattgcaaaaattttctcccattctgtaggttgcctgttcactctttttagtttctaaattttttagtttcttttgctgtgcagaagctctttagtttaattagatcccatttgtcaattttggcttttgttgccatttcttttggtgttttagacatgaagtctttgcccatgtctatgtcctgaatggtattgcccaggttttcttctaggatttttatggtcctaggtcttatgtttaagtctttgatccatcttgagttgatttttgtataaggtgtaaggaaggtgtccagtttcagttttttgcatagggctaaccagttttctcaacagtatttattaaatagagaatattttccccattacttgtgtgtgtcaggtttgtcaaacatcacatggttgtagatgtgtggtgttatttctcaggccttcattctgtcccattggtctgtatatctgttttggtaccagtatcatgctgttttggttactctagccttgtaatatagtttgaagtcaggtagcgtgatgtctccagctttgttcttcttgcccaggattgtcattggctatgtgggctcttttttggttccatatgaagtttaaagtagttttttccaattctgtgaagaaagtcaatggtagcttgatggggatagcattgaatctataaattactttgggcagtatggccattttcatgatattggttcttcctatccatgagcaaggaatgttttttccatatgtttgtgtcctcttttatttgcttgagcagttgtttgtagttctccttgaagaggtctttcacatcccttgtaagtcgtattcctaggtattttattctctttgtagcagttgtgaatgggagttcactcatgatttggctctctgtttgtctgttattagggtatagaatgcttgtgatttttgcacatttattttgtatcctgagactttgctgaagttgcttatcagcttaaggagattttgggctgagacagtggggttttctaaatatacaatcatgtcatctgcaaacagagacaatttgacttcttctcttcctatttgaatatcctttatcgctttctcttgcctgattgccctggccagaacgtccaatattatgttgaataggagtggtaagagaggtcatccttgtcttgtgctggttttcaaagggaatgcttccagtttttgcccattcaatatgatattggctgtgggcttgtcataaatagctcttgttattttgagatgtgttccatcaatacctagtttattgagagtttttagcaggaaggagtgttgaattttgtcaaaggccttttctgcatctattaagataatcgtgttttttgtcattggtttggtttatgtgatggattacatttattgatttgcgtatgttgaaccagccttgcatccaggtatgaagccgacttgatcatggtggataagatttttgatgtgctgctggattcggcttgccagtattatattgagaatttttgcatcgatgttcatcagggatattggcttgaaattttcctttgttgtgtctctgccaggttttggtatcaggatgatgctggcctcataaaatgagttggggggattccctctttttctattgtttagaatagtttcagaaggaatggtaccagctactttttgtgcctctggtagaattcagctattaatccatctggtcctggactttttttggttggtaggctattaattactgcctcaatttcagaacttgttaatggtttattcagggattcaacttcttcctggcttagacttgggagggtgtatgtgtccaggaatttatccatttcttctagattttctagtttatttgtgtggaggtgtttatactattatctgatggtagtttgtgtttctgtggaattagtggtgatatcccccatatcatcctagcactttcagaggctgaggtgggtggattacctgaggtcaggagtttgaaaccagcctggccaacatggtgaaaccccgtctctactaaaaatacaacaattagccaggcatggtgacacatacccgtaatcccagctacttgggaggctaagacaggagaattgcttgaacccaggaggtggaggttgcagcaagccaagatcgcaccactgcactccagcctgggtgacagagacaagactctgtctcaaaaaaaaacaaaaaataaacaataataatttgctcacttaatattcccagaaacaatgccttagcccgtgtttgttcgttttgttttgttggtattttttctttttcttatttctttccaggtgaagtagaattcaccaatttttaggaagatgtatattttccccaggacatgttagctggtgttttcttctgttgttgactagcacttttctgaatctctcaaggtatagcaagagccggttgatgtaaactatactttataacatcttattttccagaactccatgagtgctgctgctgcttttgttgttgttgttgttttaaaagcataccccagccaccgtttatggcatcaaaagcattataaaatatgtgtaattatttcttgagtacccccttcctcctcctcctcctcctcctgtctccctctctctgtctctctctctgtctttctctctgtctctctctgtctctctcgtctctgtctctctgttggtgtgtctctgtctgtctctgtctctctctctctgtctctcttgctctccctccctctctttctttttaaaataagctcaggtagatctaatccatttccaaggcctgaattcttaactttagaaaccccagatttcatctccatacagaatcctgtacaaaactgacgagttgatttctggacttggatgcctaataggtattacctattaataaagacccaaccctaaaatctgggtttgcttctcccttgactcacctgtgatccagacttaccgtctcaataaattgtaccactgttcacctaggattctgggaggattttcccaatctgtatttccccgtgtcctaaaggacccatgaccaagccctgtccgttctgtctcaaatatgtatctccaaacacttctctcaatttccacaactacccgcagccccttgtggaacaactggctctttgaaaaacatcccagaagttgtttcagctttttgctatgaggcctaagcctgaggcctaagacgctctctgtctctttttctctatctctgtctccctctctgtctctctctctgtgtctctctctcttgtctttctgtctttgtctctctctgtctctgtctctctctgtctctgtttctctgtctctctgtgtgtgtctgtctttgtctttctctgtctgtctctctctgtgtatttgtctctctgtgtgtgtctctctctgtctctctgtctccccctctgtctcagtgtctgtctgtctctctgtctctgtctgtgtctctgtctctctccatctgtccatctctctctgcctctgtctctctctctctgtctctccctctcttggtctcagtgtctctctctgtctctgtctctctctctctgtctgtctctctctctctgtccatctctctgtctctgtctctctttctctgtcactgtctctctctctgtgcatctgtctctttctctctctgtgtgtgtgtctctctctctgtctctctcctttcctctctttctttttaaaataagttcaggtagatctaattcattttcaaggcctgaattcttaactttagaaaccccagatttgatctacatacagaatcctgtacagaactggcaagttggtttctggacttggatacctcatagatattacatattaatagagacccaaccctaaaatctgggtttgcttctcccttgactcagctgtgacccagacattctatctcgatttttttttaaaggaagaatttatttaaatcatttttatatttagtatatattcataaattcttattttattttattaaatagattaaaatatgttactgttctaatttatgttgatgataaatttgtatcagatttagccaaagggagctcttcaatcttgttccaagatccttttgacatgttcctatcattatttgagcactttcttactgaaaacagttgtgaaggaagagttgtaatttcccaggaaaataaaaggatgagagaaaaattactctaggcagaaacagcatcatatgctatggcagaaaactatgaaatagtacagtgtattctgatatctacaatattatcaattttctgagtgatggaataatgagagatgagactgaaaggaaagcaaataagggttttatatactattctaaggaactgaaattttatcctgtaagtgataatcaactattgatataaattatgaagctaacattttgggacagcaatgcctattttatcatctttatgtacagaaatctcaggagaacttccatattttttaatcagccctagtaaataataattctttcagctatgcttttttggttttgtcagaaatgctttgaggctcattgtcttgaataagcaagtagaaaagttgtaaaactattagattgaagacaatatgaaaattattttcagatgtacaaagtgccctgtagtcctgagcctacaaactctaccattgccagtgtttccctagagctttggaaccactttctcctaattggagagagttatatgaaagtctaaatgctttgtatatctgaacacacattctttaaattaccaaggaccctaactatttaagctgaccatattactattacctatctttgctctttaagtttcctaggaaagctattccttatcttaggcggtttgctcttcagaaagatccaggaaatagaaatacaaggaattgaagctgcaaataccatgtggaatagaggcagtaatattaataggaacagaacaagtctcctgatatttgcagtatatccaaaaaatgaataatgatttacactttatgtagtttagggagcttttctactgcttgttttgaaaaatgaagtttcttgaggttctgaatttaatcaagaaggacctgcatgaacatcagaacatcttgtttctgctatgttctctcctatgatcaaaggcatcttttcttcatttattttgtgtgtgtgtgtgtttgtgtgtgtgtgtgtgtgtgtgtgtgtgtttgtttttttttttttttttgagacagagtctcactctgttgcccaggctggagtgcagtggtgcaatctcggctcactgcaacctctgcctcccggattcaaggaattctcgtgcctcagccttctgagtagctgggactacaggctcctgacaccatgcatgactaattttttgtattttaacagtaatggggtttcaccatgttacccagagtggtctcaaactcctgagttcaggcagtccacctgtgtcagcctcccaaagtgttaggattacagacatgagccattgcacccgacccatttccttttcattttaaaaatggattttcagggaaggccggtcatggtggctcacacctgtaatcctaacactttgggaggccaggggtttgaaaccagtctgagcaacatagggagaccccatctgtgcaaaacatcagaaaattagccaggtatggtggtgtgcacctgtggtgccagctactcgatggggtgagacaggaggatcatttgagccagcaggtcaaagttgcagtgagccgtgatcacgcaactgcactccagcctgagcaacaaagccagaccctgtctcaaaaccaagatgaaacattgtatattaagaactgactggtttaagaggatgcattttaactgagaaaaataatttcattggtataaatagctccatttcaagatgaccacaccacaaaaaaaggttactgatagataacaaagatccatattgttactctgctcagtagaaaggaatccatttgtactttctgtgaccctttggaggctttctacatcatagatagtgtcattagtatttaaccatgtctttgatgatgacaatcctgagtgaacccctattcattttgcgctgagttcttacatagtcttttcagtgattataactgtaccatggaggataggaaatctcactaacatttttattacttcctctgcaaaaattctgaactaaaatatagtcaacctcatctctggactaaactggaaaatgtaagagacaagttaagttgtacttatggaactgtaggctcattagagaaacctgtagcatcaatttgtgcccactttagaatagctttaatcctacaaatctacttaagaaaagtaaacccattgcaggggaatgctgtcagtttagatgttataataattcagtctgtcactcttagctccttagctcagttcagacagctatagtggggaagatgtctagactccctcccctacctctgccccaactctcaaataaaaatcctatatcctaaagaaccttgtagtttatttttaccaaacaagctagtctacctgcaaattaacagtaacagtgatatcaccaggtaattttaatattgtaaattaaagtgagtattctcttgaatgctatgatcttctcagtgggacatgtattttcacatgttttgtaatacatatgagtttaataaagctaatgccctcgcagattctctttgtgaccattagtaatcatttgtaaggtagctatcagaatatatttgtggccatgaaatagttttgcttcataggaaactattttttctatccaaaagtaaaacttatttttcattataaccttaccttttttaaaatgtttcattccttcctttcctgtttctgcctaaaggggttttatgggctaccggctgctaggtgataactcactggggccttcaagaggaaaaagtgcatacttttttctcaatttttttttctcttctaacaaacttctgttctacagtcacaatcaacaagagaaacaatcaacattttttggtcctttttcctgctgattaagtttgttgttgttgttgttgttgttgttgttgttttgagagagagtctcaccgtgtcgcccaggctggagtgcagtggcaccatctcggctcactgcaagctccgcctcccgggttcacgcctttctcctgcctcagcctccggagtagctgggactacaggcgcccgccaccacacccggctaatttttttgtatttttagtagagacggggtttcaccgtgttagccaggatgttttctaatggcccaagacagtaagaggtgctttgggtttgtaatttacaaaataagagaagtctgtgacaacttttttttttttttgagacagagtctcgctctgttgccaggctggagtgcaggggcgtgatctcagctcactgcaacctccgcctcctgggttcaagcaattcttctgcctcagcctcccgagtagctgggactacaggcatgcgccaccacgaccagctaatttttgtatttttagtagagacggggtttcaccatgttggccaggatggtcttgatcatttgacctcgtgatccgcccacctcagcctcccaaagtgctgggattacaggcgtgagccaccgcgcccggctgaagtaggtttttttattggcgaagtagctaattactgtataatttggggtgagtcttgagtgggaagaagcctcgtggcacataaaaaggtgcttaattgatattgaaaacacacgcacgcacacacatgcatgcacacacaaccctacctgctgatgtgccagagaattacaatactcctcctttgagacattgcttttagttaatttgttatatatccaaaggtccttgtgttaacatgcaaatagtttaaccaaggaccggtatcaatccaatagcaccacagtatgttaatttcttcaattaagttattccacaatgtatgcatatctcaaaacatcatggtatacaccatgcatatataaaatttttgccaattaaaaataaattttaaataaaatgtttatactataggtctataaaaaagtacaaattatttttccggtgaggtaatcactttatgacaaagactttataaatattcagtggcttagagaagtaaaatgacagcagaaagcactgctttactttttgcttcccaattttggactttgtttgaaagatttgccattcattaaataccccaagtatttactgagtatctactataagtgtaaggaaggcactattctaaaagtgacagagaatacaaagattaataagacataggctctgtcttcaatgagtttaccatctactagcagaggtaaggcaaatatttaaatatctatagcataagatggagagtgatagataccagaagacaaatataaacaaggtataacattactttagtgatggaagagattattcctgccagtagataaccatactgcaatttccaaacaacaagaaaaaaaaacaaggaggggccaagatgaccaactaaaaacagctacggttggaggctcccacgtagaagaatgaaaacagcgagtaaatcctatgccagcaacttgaggtatccaggttctctcactaggactgaccaggcagttggtgcaacccatggtaagtgaggaaaagcagagtggagtgacagccaacccaggatccacacaggggaaggggaactcccactcccagccaagggaggtagtgagtgattgtgctaccccgcctggggaaccatgctttttccatggatctgtgcaacccacagatcaggagattcccctcataagtccacaccacccaggccttggttcccaagcacagaactgtgcagattcttggcagccgctcaggtggagactgcctaagacaaccaagttcctaggggagggggcggctgccatcactgcagctgcctgctgccagagatgactgagctcccagtgggaggagtggctgccatcactgcaactgcctgctgccaagacaactgagctcctgcggggagagacggctgccatcactgcagctccagtctgccagtttagagaggaaaataaataacctgatggagctgaaaaacacaacacaagaacttcataatacaaccacaagtatcaatagctggatagaccaagggaaggaaggaatttcggagcttgaagactatcttgctgaaataagacaggcagacaagattagagaaaaaagaatgaaaaggaatgaacaaaacctctgagaactatgggattatgtaaaaagaccaaacctacaactgattggggtacctgaaagagatgggagaatggaaccaagttggaaaacgtacatcaggatatcatccagaacttccccaacctagcaagataggccaacattcaaattcaggaaatccagagaaccacagtaagatactccatgagaagaaaggtcatccccaagacacataatcatcagattctccaaagtaaaaatgaagggaaagtattaagggcagccagagaaaaaggccaggttacctataaagggaagcccatcagactaacagtggacctctcagcagaaaccctacaagccagaagagattgggggccaatattcagtatccttaaaagaaagaatttccaacccagaatttcataaccagccaaactaaacttcgtaaagtgaaggaaaaataaaatccttttcagaaaaacaaatactgagggaatttgtcaccaccaggcctgccttgcaggagctcctgagagaagcactaaatatggaaagaaaaaaccaatacctgccactacaaacacacactaaagtacacagaccaatgacgcttcgaagcaactacatcaacaagtctgcaaaataaccagctagcatcatgatgacaggatcaaattcacaaatatattaaccttaaatgtaaatgagctaaatgcctccagttgaaagacacagaatggcaagctggataaagagtcaagacccatcaatgtgctgtattaaagagacccatctcatgtgcaaagacacacataggctcaaaataaagagatggaggaaattttaccaagcaaatagcagagaaaaccaggggttgcaatcctagtgttaaagtcttacaaaacagacattaaaccaaaaaaaaaaaaagatcaaaaaagacaagggcattacataacggtaaagggctcaattcaacaagaagtgctaactatcctaaatatacaggaggacctagattcataaaacaagttcttagagacctacaaagagacttagactcccacacaataatagtgggaggctttaatactgcactgtcaatattagatcactgagacaaaaaattaacaaagatattcaggacccaaactcaactctggatcaagtggacctgacagatatctacagaactctccacccaaaaacaacagaatatatattcttctttgtgccatatggcacttactcctaaaaagattgcataattggaagtaaaacactcctaacaaatgccaaacaactgaaatcagaagaaacagtctctcagaccacagtgcaataaaattagaactcaaggttaagaaactcactcaaaaccacacaactacatggaaattaagcaacctgcccctgaatgactcctggataaataacgaaatcaaggcagaaatcaagaagttctttgaaaccaatgagaataaagagacatcatgccagaacctctgggacgcagccaaagcagcgttaagagggcaagttatagcactaaatgcccacatcagaaagttaaaagatctcaaattgacgtcctaatatcaaaattaaaagaactagagaaccaagagcaaaaaagaaaaaaaaaaggccaaagctagcagaagacaagaaataaccaagatcagagcagaactgaaggagatagagacacgaaaaaccttaaaaaaaatcaatgaatctaggagctggtttgttttttttttttttggaaaaaaaaattaataaaatagactactagctagactaataaggaaagagagaagaatcaaatagacacaataaaaaatgataaaggggatatcaccactgaccccacagaaatatgaacaaccatcagagaatactataaacacctctatgcaaataaactagaaaatctagaagaaatggataaattcctagacacacacaccctcgcaagacagaaccaggaagaagttgaatctctgaatagacaataacaagttctgaaattgaggcagtaattaatagcctaccaaccaaaaaaagcccaggaccagatggattcacagccgaattctacgagaggtacaaagaggagctggtaccatttcttctgaaactattctaaacaactgaaaaggagggactcctctctgactcattttatgaggccagcatcatcctgatatcaaaacctggcagagatacaacaaaaaaagaaaacttcaggccaatatccctgatgatcattgatgcaaaaattctcaataaaatactgacaaaccgaatccagcagcacatcaaaaagcttatccacatgatcaagacagcttcatccccaagatacaaggctggttcaacatatgcaaatcaataaacgagatttatcacataaacagaactaaacacaaaaaccgcatgattatctcaatagacacagaaaaggcctttgataaaattcaacttcccttcatgttaaaaactttcaataaactaggtattgttggaacatacctcaaaatataagagcaatttatgacaaacccacagccaatatcatactgaatgggaaaaagctcaaagcattccccttgaaaatcagcacaagacaaggatgccttctctcaccactcctattcaacatagaattggaaattctggccagggcaatcaggcaagagaaagaaataaagcatattcagataggaagagaggaagtcaagccatctgtttgcagatgacatactcctatatctgaaaaccccatcatctcagccccaaagcttcttaagctgataagcaccttcagcaaagtacaaaatcaatgtgcaaaaatcacaagcattcctatacaccagcagtagacaagcaggaagccaaatcatgaatgaattccctttcacagttgctaaaaagagaaaaaatacctaggaatacagctaacaagggaagtgaaggacctcttcaaggagaactacaaactgctgctcaaggaaatcagagagcacacaaacaaatggaaaaacattccacgctcatggatgggaagaatcaatatcatgaaaatggccatactgcccagagtaatttatagattcaatgctgttcccattaaactacccttgacatttttcacagaattagaaaaaaactactttaaagttcatatggaaccaaaaaagagcctatataatgaagacaatcctaagcaaaaagaacaaagctgaaggcatcacatatctgacttcaaactcaactacaaggctatagtaaccaaaatagatggtagtagtacaaaaacagacacatagaccagtggaacagaatatagaagtcaaaactaagactgcacatctacagccatgtgatcttcaacaaacctgacaaaagcaatggggaaaggatttgctatttaataaatggtgctgggagaactggctagccatatgcagaaaattgaaaccggaccctttccttataccttatacaaaagttaagtcaagatggattaaatatttaaatgtaaaacccaaaactgtaaaaatcctagaagaaaatctaggcaataccattcaggacatagatacggacaaagatttcgtgacaaaaacgtcaaaagcaattgcaacaaaagcaaaaattgacaaatgagatctaattaaagagcttctgcacagcaaaagaaactgtcatcagagtgaagagacaaactacagaatgggagaaaattattgcaatctatccctcagacaaaggtctaatatccagaatctacaagaaaaaaataaccccatttaaaagtgggcaaaggatatgtacagacacttctcaagagaagatatacatgcagccaacaaacatggaaaaaagctcaacatcactgatcattagagaaatgcaaatcaaaaacacaatgagataccatctcaggccagtcagaatggcaattattaaaaagtcaagaaacaacagatgctggcaaggctgtggagaaatgggaactcttttacactgttggtagttcaaccattgtggaagacagtgtggtgattcctcaaagacctagaactagatataccatttgatccagcaatcccattactgggtatatacccaaaggaatataaatcattcctttgtaaagatacatgcatgcgtatgctcattgcagcatttattcacaatagcaaagacgtggaatcaacccaaacgcctatcaatgatagactggataaagaaaatgtggtacctatgtgtccagaattggtgagttcttggtctcgctgacttcaagaatgaagccgcggaccctcgcagtgagtgttacagttcttaaagatggtgtgtccggagtttgttccttcagatgttcagatgtgtccagaatttcttccttctggtgggttcgtgatctcactgacttcaggagtgaagctgcagaccttcacagtgagtgtcacagctcttaaaggtggcacggctggagttgttcattccttccagtgggttcgtggtcttgctggcttcaggagtgaagctgcagaccttcaccgtgagtgttacagctcttaaaggcagcacggacccaaagagtgagcagcagcaagatttattgtgaagagtgaaagaacaaagcttccacagcatggagggggaccccagcaggttgctgctgctggcttgggcagcctgcttttattcccttatctgacctcacccacatcctgccaattggcccattttacagagagctgattggtccgttttcacaggttgctgattggtgcgtttacaaaccttgagctagacacagagtgctgattggtgcatttacaatcctttagctagacacaaaagttctccaagtccccactagattagctagacacagagcactgattggtgcatttacaaaccttgagcaagacgcagagcactgattggtgcatttataaaccttgagctagacacagagtgctgattggtgtgtttataatcctttagctagacacagagtgctgattggtggatgtacaatccgctagctagacataaaagttctctaagtccccaccagattagctagatacagagcgctgattggtgcatccacaaacccgagctagacacagagtgctgattggtgcatatacaatcctccagctagacataaaagttctccaagtccccaccagactcaggagcccagctggcttcacctagtggatcacacgccagggccgtgggtggagctgcccaccagacccacaccacgtgcccacactcagcccttgggcagtccatgggactgggcgctgtggagcagggggtggcacctgtcgtggcaggagcccacagtgggggtgggggggggtcactcaggcatggcgggctgcaggtcctgagccctgccccgcaaggaggcggctgaggcccagcgagaattcgagcgggcgctcgcgggtcggcaatgctgggagacccagcacaccctccgcagctgctggcctgggggctaagcccctcactgcagggcccgccgtacccacgcccacccagaactcgtgctggcccgcaagtgccacccacagccccagttcccacccacgcctctccctccacacctccctgcaagcagagggagccggctctggcctcggccagcccagagaggggttcccacagtgcagcggcaggctgaagggcttaagtgcagccagagtggacgtgaggccaaggaggtgccaagagtgagtgggggctgctagcatattgtcacctctcacctatacaccatggaatgctatgcagccgtaaaaaggaatgagatcatgtcctttgcagggacagggagggagctggaagccattatcctcagtaaactaacacaggaacagaaaaccaaacactgcatgttctcacttaaagtgggagttgaacaacaagaacacatgggcacatgggtggggggggcaacagcacacactgggtcctgtcagagggttgcagggaaggagagcatcagaaagaatagctgggcctaatacctaggtaatggattgatccgtgcagcaaaccaccatggcacaagtttacctatgtaacaaacctgcacatcctgcacatgtatcctggaacagtaaataaaataagtaaaataaaaaaataaaacttaacagaaccatcaggtggtttactaccctctttttctttctccttcttttcttgcttccttccttccttcctctttctctttcttgttctctttctctttctttcattttcttacctttctgctggactgttacattcttcatggcaggatatattttactgtcagtatcccaagtccctaactgtttctggttcataaaatgcagtcagtaaatatttgttgaatgggtatgtgtatcactgatcatcaaacttgctgtttaataagaaaatgcctattacaaagcatattcaacagataaaacctatgtaactaaaaagtagaattttcttctcagaaactaaacatatttttaaaagaaacttttgtaagattatatccagtttgcaccataaagtgcagcctatcacaaaaaaaaactgtctgatctgagacctataaagctgaataagaagcagaagcagcaatatcattctgcctagttacactggttgtgaatgatttttttatatttgaatgagtaggtcaagacctcaatgaaaatgagttataaataagtttatatttcaatccttttttaagtgttcacccacaatttgaatagaaaattctgtctagcaataaataatctctaaggtttttcaaactttgaaaattttgcgattttgattgaccatgagaagaaatcacatattaatagtataagcaactttgtatatatttttcttaggtgcctatgacaatgtcattagtcttagaatgaaaaccctttggggtagtgcctttaagtcagttcattgaacatgtctggagcagccactgggttttgacacatgatgtaacattgctaacttgatttaatgttccaccagagcaggctgtattttggaggcaggagaaacagtttcttacctgctaatcttcatctggggacatttgaaattgggagttgtgatattataagtcattgccactttttaatcagtgttacagcatcatattcttagttaattatcttactgtttaggtcacagtgctgtcgatatcaccaaggtggctagaagacatcgcatgtctccttttcctctgacatctatggacaaagcctttatcacagtcctggagatgactccggtgcttgggacagaaatcatcaattaccgaggtactattatatttgaccattgccctttcttttcttcatttttttccaaataagattcatgtaacattaatgcacagttttcctgaaaaagaaagattattaaccattattacagttatcatcattctttttttttcttatttctactcaataagaaaaaggctaagggttcagccttaacagtatacagagtaaaatccatgaaactgccttttcattaaaaaaaggaaaaaaaaaaaaaaaggaagaaaatcagctgtgtttctgctgtccatgaaaataccaatactgcaaactaaagaaagggttctcagcactgagtgaggaaagtagttaactctgagtctgtatgatgtcctttctgtcagaaatgggagacaactaatatgtcttgtaatcatctttttctgtttggaaaacctgtatttaaatgtaaaaatgtaaaaaaaaatattaatttatccatggatactaagacaacggaaaggtagcattccccagtattttgtttttaattaacaacttccatttctaaaaattcagcataggagttgtatttaggcatccagttccaggagaccaggctcctgaggagaacttccagccaataaagcttgtggtttctccccaacaccaaaaagagaagttgtatttagtgcaatttgaataaaatatagtttcttaatttgttatgcagaaacaacacaacagaattaattttataaataaaaaactttatagaatcataaaatattcaaactacaatgaacagtagagagcacaaacaccctaatttttttgtcaaggaaactcaaactcagaatagcagaaaatgaataggattaaggtctcaagatttacattcttccttttactacataattgtgctcttcttcaaccattaaattataaaaaataatggcagctaacttactggtgccagattttagctctttcgtctgtgtccccacttagacaaggattgttattatacagtttgcccttatcctacgtctttggttcacattcttttagatatgcatatcattaggcttaaatcgtttgtttttcttttactcctcaataaaggaaagattagaaaactcactagagtaggggattagtcaggaattaactatgtgatttcagaacaattttaatggaatagttttgtttattattaaaggtagaatgttgagatatttattggtatcagtagaaaccaagacattttcagaaaatatgaatgtaaacttaagttataaaaaaattaataatactttacctgttataaaaataaataaaccatccctggttttttcttttttataatttcagaggagtttcccttaacatcagtccttagaaaaatctcaccatgtattccaggtcacatttaaagagacattctaatttaaaaaaaaaaaaaaaagagttggaaattgccatttcatttttcctccagagaaaaatgctgtcatatgtattctcttttcccttcatgtgcttgtttcccattcatttgttcatcaaatcagttgtcacttgtacttgagcagactcttcatagatggataactttttgtcaagtgtttccacctatgatgatgaaaaataataatgaggttcacattaaacctttgaattggatcaaactcaattttttgtgcaaatgggtattgtaattagaccccctaggcactttgattaggtgtttagaaaccatcatacatagaaacttaatttactttgttcaacaaatatttaataaacatcaagtaaatgtcagatactatgttaagtcctgtatttgcaaagatgaataaaaataaaactcctgccccatggatttcataggctagtgcagaagagatgggtaaattaatgtggtacttgtctcctttaattggctcctttacaggcttgccttcctttgtcaattccttgaaaagctttctttacagttttttttctttggctcttttcacatcttgtccattgacttcagatggcctcatgcaggctagtagtttcagataccatttataaagtgaattgtaagtctataccattgcccagagcttgtccaagctccaaactcatattctaaatgtattatgtatctgctgccagtaaatataacatgacaaatactaaacttattttgtcgacaatacttgtttttctacatcctcttaaaactgtcccttgttctacattccctctgttactgttttagtttaggtgttttttttcttttttttatttttctgagatggagttttgctcttgttgcccagtctggagtgcaatggcacgatctcggttcacggcaacctccacttcccaggttcaagtgattctcctgcctcagcctcctgagtacctgggattacaggcatgcaccactatgcccagctaattttgtatttttagtagagatggggtttctccatgttggtcaggctggtctcgaactcccagtctcaggtgatccacccacctcgacctctcaaagtgctcacaggagtgagccaatgcgcctggcccagtttaggtctttattattaacttcctggacaattgttataggctcccctccccccagttaacatcttcccaatccgttctccaatttgatgccaaagtaatctgttcaaatttgctaattcgttattaacactccctacacgcaactcttcagcagttttttcataacctcaagataaaattcaaactccttaacatgtcatgaaaggccctttataatctgatttcttctaatatttttgtttcttctcttacctccttatcatcagaccttgcttctccctaaacctgacatgatgattcttacttcttattctctcttacctctaaggctttatttatatatcctttttttttaagagactaggtctcactatgtttcccaggctggccctcaactctcagcctcaagcgatcctctcgccttagcctcccaaagtactagtattacaggcataagccaccatgcctggcccctttgcttatatagtttttgcttggaaaaactttatcttacttctctacatattaactactgcctaactaccacatattctttaagatcaagcttaagatgcttctcctttatgaagaagtctttcctgatgtctgcttccccctttccctagctgagttaaacactcttcattcgtgttcccatagcaccttcttcatatgttttgtaagacaactgactgaaatatttgttcactattaattttaaatgccctaataaataacatggatataaaaaaaaagcagagttctgtaagtgtgaatcactgtaaattgaattgtcataagtaaaataaagcctagaaaaaaaggtagaagttcattctcactacactttagaatattttctttaccaagtgtatttgcgttttaatgagcaaacctttatagtttgttttgatttcagctagatgtacctctaaactatttaatatcattcattaatcactgagtaggaaaaagtatttgggggaaccaaaaggccttcacattctatgaaattacaaatactttgcctctgcaaacactctaacacctgcaatcacagaagcccttagaggaaagccagtgttttgtaaggaaaatctaggaccaactgaatccatgcatttgaagctgtgacatctctaaaatgatttttatatgtctaagaaggttcaataataatcccagaaaactaaggacttaacatgtagagaaaatgctgaaagtgattgttgtgaaggtcatagacacagggaactctatgaaggaatttcagagtatagtacatgaaacactttagatataatagtaagactaagagggtaacttgagatcaaatgagcattttttcttgtgtctgttggctgcataaatgtcttcttttgagaagtgtctgttcatatcctttgcccactttttgatgggttgtttggtttttttcttgtaaatttgtttaagttcttttagtagattctggatattagccctttgtcagatgggcagattgcaaaaattttctcccattctgtaggttgcctattcactctgatggtagtttcttttaccgtgcagaaagttctttagtttaattagatcccattcatcaattttgcttttgttgccattgctttttgtgctttagtcatgaagtccttgcccatgcctatgtcctgaatggtattgcctaggttttcttctaggatttttatggttttaggtctaacatttaagtctttaatccatcttgaattaatttttgtataaggtataaggaagatccagtttcagctttccagtttcagctttctacatatgcctagccagttttcccagcaccatttattaaatagggaatcctttcccatttcttgtttttgtcaggattgtcaaagatcagatggttgtagatgggtggtgttatttctgaggcctctgttctgttccattggtctatatatctgttttggtactagtaccatgctgttttggttactgtagccttgtagtgtagtttgaagtctggtagtgtgatgcttccagctttgttatttttgcttaggattgtcttggcaatgagagctcttttttggttccatgtgagctttaaagtagccttttccaattctgtgaagaaagtcattggtagcttgatggggttggcattgaatctataaattaccttgggcagtatggccattttcatgatattgattcttctatccatgagcatggaatgttcttccatttgtttgtgtcctcttttatttcattgagcagtaatttgtagttctccttgaagaggtccttcacatcccttgtaaattggattcctaggtattttattctctttgtatcaattgtgaatgggagttcactcgtgatttggctctccatgtgtctgttattggtgtataggaatgcttgtgatttttgcaggttgattttgtatcttgagactttgctgaagttgcttatcagcttaaggagattttgggctgagacgatggagttttctaaatagacaatcatgtcatctgcaaacagagacaatttgacttcctcttttcctaattgaataccttttatttctttcttttgcctgattgtccctggccagaacttccaacaccatgttgaataggagtggtgagagaagacatccttgtgttgtgctggttttcaaagggaatgcttccagtttttgcccattcagtatgatattggctgtgggtttgtcataaatagctcttattattttgagatgcattccatcaatacctagtttattgagagtttttagcatgaagggctgttgagttttgtcgaaggccttttctgcatctattgagataatcatgtggtttttgtcattggtttggtttatgtgatggattacgtttattgatttgcattttttgaaccagcctttcatctcagggatgaagccgacttgatcgtggtggataagcttttcgatgggctgccggattcggtttgccagtattttattgaggatttttgcatcgatgttcttcagggatattggtctaaaattctctttttttgttgtgtctctgccaggttttggtatcaagatgatgctagcctcataaaatgagttagggaggattccctctttttctattgattggaatagtttcagaaggaatgataccaactcctctttgtacctctcgtagaatttggctgtgaatccatctggtcctggactttttttggttggtaggctattaattattgcctcaatttcagagcccattattggtctattcagagattcaacttcttcctgctttagtcttgggagggtgtatgtgtccaggaatttatccatttcttctagattttttagtttatttgcatagaggtgtttatggtattctctgatggtaatttgtatttctgtgggatcagtggtgatatcccctttatcattttttattgcatctatttggttcttatctcttttcttctttattagtcatgctagcggtctatcaattttgtcgatcctttcaaaaaccagctcctggattcattgattttttgaagggtttttcgtgtctctgtctccttcagttctgctctgatcttagttatttcttgccttctgctagcttttgaatgtgtttgctcttgcttctctagttcttttaattatgatgttagggtgtcaattttagatctttcctgctttctcttgtgggcatttagtgctataagtttccctctacacactgctttaaatgtgtcccagagattctggtacatcatgtcttcgttctcattggtttcaaagaacatctttatttctgccttcatttcattatgtacccagtagtcattcaggagcaggttgttcagtttccatgtgcttgtgcggttttgagtgagtttcttaatcctgagttctaatttgattgcactgtggtctgagagacagtatgttgtgatttctgttcttttacatttgctgaggagtgctttacttccaattatgttgtcaattttagaatacgtgcaatgtggtgctgagaagactgtatattctgttgatttggggtggagaactctgtagatgtctattaggtctgcttggtccagagctgagtttgagtcctggatatccttgttaaccttctgtctcgttgatctaatattgacagtggggtgttaaagtctcccattattattgtgtgggagtcgaagtctctttgtaggtctctaaggacttgctttacgaatctgggtgctcctgtcttgggtgcatatatatttagaatagttagctcttcctgctgcattgatccctttaccattatataatggccttctttgtctcttttgatctttgttggtttaaagtctgttttatgagagattaggatggcaacccctgcttttttttttttttttgctttccatttgattgttagatcttcctccatccctttattttgagcctatgtgtgtctttgcacagagatgggtctcctgaatacagcacattgatggggcttgactctttatccaatttgccagtctgtgtcttttaattggggcatttagcctatttacatttaaggtccatattgttaggtgtagatttgatcctgtcattatgatgttacctggttattttacctgttaattgatgcagtttcttcatagcattgatgttctttacaatttggcaggtttttgcagtggctggtaccagttgttcctttccatgtttagtgcttcctttaggaactcttgtaacacaggcctggtggtgacaaaatctctgagcatttgcttgtctgtaaaggactttatttctccttcatttatgttggctggatatgaaattctgggttgaaaattcttttctttaagaatgttgaatattggcccccactctcttctggattgcagggtttctgcagagagatccgcagttagtctgatgggcttccctttgtgggtaacctgacctttctctctggctgcccttaacattttttccttcatttcaaccttggtgaaattgacaattatgtgtcttggggttgtttttctcgaggagtatctttgtggtgttctctgtattccctgaaattgaatgctggcctgccttgctaagttgggaaagttctccttgataatgtcctaaagagtgtttttcaacctggttccattctccctatcactttgaagtacaacaatcaaatgtagaatttgtcttttcacatagtcccatatttcttggaggctttgttcgtttctttttactcttttttttctaaacttgccttctcactttatttcattaatttgatcttcaatcactgatatcctttcttccatttgatcaaatttgctattgaagctagtgcatgcctcccgaagttctcgtgccttggttttcagctacatcaggtcacttaaggtcttctctacactgtttattctcattagccattcgtctaaccttttttcaaggtttttagcttccttgtgatgggttagaacatgctcctttagctcggagaagtttgttattacggaccttctgaagcctacttctgtcaacttgtcaaagacattctccatctagctttgttccattgctggtgaggagctgcgatcctttggaggagaaaaggcgctctggtttttagaattttcagcttttctgctctggattctcaccatctttgtggttttatctacctttggtctttgacgttggtgacctacagatggggttttggtgtggatgtcctttttgttgatggtgatgctattcctttctgtttgttagttttccttccaggagtcaggtcgctcagctgcagatctgttggagtttgctggaggtccactccagacactgtttccttgggtatcaccagcagaggctgcagaacagcaaatattgcataacagcaaatattgctgcctgatgcttcctctggaagcttcatcccagagggacacctgcctgtatgaggtgtctgctggcccctactaggagatgtctttcagttaggctacacaggggtcagggactcacttgatgatgcagtctgtccattctcagagctcaaacgacgtgctggtagaaccactgctctcttcagagctgtcagacagggacgtttaagtctgcagaattttctcctgccttttgttcagctatgccctgcccacaaaggtggagtctgtagaggcagtaggccttgctgagctgtggtgagctccgcccagttcaagcttcctggccactttgtttacctactcaagcctcagcaatggtggatgcccctccccccgccaggctgcagcctggcaggttgatctcagactgctgtgctagcagtgagcaaggctccatgggtttgggacctgccaagccaggcatgggagagaatctcctggtctgccagttgctaagactgtgggaaaagcacaggatttgggcaggaatgccccgtttttcgaggtacaatctgtcacggcttcccttggctaggaaagggaaatcccccaaccccttgcacttcctgggtgaggtgacgccccgccctgcttcgactcgccctccatgggctgcacccactgtccaacccatcccaatgagatgaactgggtacctcagttggaaatgcagaaatcacctgtcttctgcgtcggtcatgctgggagctgcagaatggagctgttcctattcggccatcttggaacagagtcccagtgatattcttaaagttagacaaatagttatggttacaacaactggaacccgggatccttaactcccagtctggtgttcatttcactatagcatactgcatctcaaatcaatgtaaacattattcttataaagcaagtgcctagacgtgtttgcatgtataaagtgttttctgtttttctattttgactaccgatgaattttctattttctctggtctgtcttttagcctattactattttcagctcctatctgcaagtgaggattttaaggaacaagtattccactgataggcattcctggcataactatggatgataacatttgtaagactaacatttatgattcattttctttatttgtaaaatgcatgacatgaataaattacaacttcacacttggtacagtatcaacttctgtaaggcagattaaaatattctggcaccattccctgaaattcccaatctttttctatatacaatggaaaaactatgagcttttttttaatagaaaggattttgctttcttgggaattttatgttagattataagctgtaagcttttttatttaagattacatgattaaagacttcagtgtctctgacctaggttctctgcttttccactttagcagttctagtcaaggaaactttaagttttgctgttggaagtaagtttggagcagtgaaatatctcttttagaatactgaccacagcacaaaggcacatgttcccgtctctgacttctagctagttagctgcctgagcataggcagttatcttaagctgagattggcttccctttagaagaaattctgaagctcttgattccaagcagtaggaagtcctcaccaaggtcatactgggagttcattaactcttcctgatggttcaggggctgttagagaataagggaaaaggaaataaggtatacttagaagtagctttgtcaagacactctttggctcttttacttgctctaccttttactagccaaatgaccctggacaagctacttaacctttctaggtcttatctccctcctatgcaaaatggaaataatgtctacccaatgtagggttattgtaggatactattaaaggagataatattgtgtaaataattttattttcgctaacatgctctatttggaattcagcaactgcttccctttcctctactctcctaacatggggattctaagatcataaccctgagataagcacttgtaaattacagagtatttacagtatgaccttggtgaggacttcctactgcttggaatcaagagcttcagaatttcttctaaagggaagccaatctcagcttaagataactgcctatgctcaggcagctaactagctggaagtcagagacgggaacatgtgcctatgtgccgtggtcagtattctaaaagagatacttcactgctacaaacttagttccaacagcaaaacttaaaggttccttgactagaactgctaaagtggaaaaacaaagaacctaggtcaaagacactgaagtctttaatcatgtaatcttaaataaaaaagcttacagcttataatctaaaataaaattcccaagacagcaaaagctaaaattggctcaactccatttgttggcctgcatctggatcctgtatgcattttgatgtaatcaaattttaattccacccacccaggtcattcaggaatatatctctgtctcattagaaaatttaattaagcagcagtttttattttattttttatttttgctcttctctgattgagctgtacaaaattgaagcaaagaattgagatacctattcaaatatttcaagtgaaagcatatatttttattatccaaatcactgccttaagtttctaccttcagtctagtaaggtcttcacttagaatgattctacttgcaaagggatgttggtctgtgctggcatttgctgtctattttttaatttttccatgaatgtggcctcttaaactcattcataattcccttcaggtattcatatctctttagactcatcattccatgaacttcattacactgctaaaatatgcacatctcattatatccttctacttctgcatcttattatatcattacctttatactccctgcattcttcaaaatgtatatcttaatccctcaatatatttttgtgacatatatgtgtgtatatatatgtttgtgtgtgtgtgtatatatatatacattttaaatatttttatatatatatatatacacacatatatatataaaatcacaacttgtaactaatcatggtatcttcatattcaaaaattatattaccggccgggcgcggtggctcacgcctgtaatcccagcacttcaggaggccgaggtgggcgggtcacaaggtcaggagttcgaggccagcctggccaatatggtgaaaccgcgtctctactaaaaatacaaaaattagctgggtgtggtggtgcacacctgtaatcccagctactggggaggctgaggcagaagaattgtttgaacccgggaggtggaggttgtagtgagctgagatcgtgccattgtactctagcctagtgacagagtgagacttcatctcaaaaaaaaaaaaaaaaaaaaaatatatatatatatccaatcagcattctgtatatgtgctttcaggtgctttttcccccagtactgtgggtcccacttgtgtgcttttaccaccgtacttattaagccttcttgtttaggggggttatttttatagctatgtaattgaataaaattacctattcacacagaaatcaggcctataccatcagagaaatgcaaatcaaaactacaatgagacaccatctcacaccagttagaatgccagtcattaaaaagtcaggaaacaacaggtgctggagaggatgtgaagaaataggaacacttttacactgttggtgggactgtaaactagttcaaccattgtggaagatagtgtggcaattcctcaaggatctagaactagaaataccatttgacccagccatcccattactgggcatatacccaaaggattataaatgatgctgctataaagactcatgcacacgtatgttgattgcagcactattcacaatagcaaagacttggaaccaacccaaatgtccatcaatgatagactggattaagaaaatgtgacacatatacaccatgaaatactatgcagccataaaaaatgatgagttcatgttctttgtagggacatgaatgaagctggaaaccatcattctgagcaaactatcgcaaggacagaaaaccaaacaccgcatgttctcactcataggtgggaattgaacaatgagaacacttggacacaggaaggggaatatcacacactggggcctgttatgggatggggggagtggggagggataacattaggagatatacctaatgtaaatgacgagttaatgggtgcagcacaccaacatggcacatgtatacatacataccaaacctgcacgtggtgcacatgtaccctggaacttaaagtataataataaaaaatttaaatttaaatttaaaaaaaaatcaggcctataaccttggcctaaattgccctatgtcgcaatcaggtagactgatcttcctttttcacacttccttctatgcataccattatatatgttcctatacatattcactcttaaaaaaaataaagtatattataaataaaaagtaaagtaggaaaatgaaatagaaaattgaaaaaagcacattacaaatatatctctttaagcaattttagtagaaaacaatacttaatccaaaaaggaagggggggttaatttttcaataggatttttaaagttaatttacacagcttttattgactatacttgtggttaaaataaggtacagtctttagatatgattcttaatatttccattatttataggtacctcattatgttttcacattttctatatacatgtcttatttgctgtagtttatcttgcaatttttaaattctgtatctattttgaagttccttagtctatagaattacatgaggattcagaatgtatgcagtggaaaaaaatgttttaagttaaaatggaaaaaaatagaaattttctcagaagtaatggcataaaaataccttattccagtaaagaaggatctccaatatttttagaaattacaactcatccctgtctattcctaatgttttattggtggaattatgaaaattagtgaaaattaaaagagaaaaccttaggtgacagtaaaggatttgccagtaccagcagggttatttttttaagtttgagtgattcactttctcattagagcacctagtgctgcaagaattacctttttgactgttttctcaagtaaagactttgcaactcctaggagaccattagctcatcccaagcagcagagggtaagtatcagggaaacccagttcttccttttatttaattgtgagacaaaagcataagaagaaaatcagagacacaaagattctaatcaacaatactctttcttatgtgtctgaatgtgtataagaatgtaacttagttgcaataatctttaatactttaactcaattttccaaaaatggaatttattgactattttctaaaatctcgttttcagtttctataaactcctcttctgcagaatcccagtctccttggttaacttcctaaaaaaaaaaaaaatacaaaccattaatgtcttatcatttggatataacagtgaatgatttggtaatactgttgcaaccctgtgactataatgccttgctaatttccttactttcattctagcaatatggaaataagccaccagtatttcttcaaagtcagtatcatagttggcatattggtatgtatttcttcttacatcccatctaggagctttgtttcatcatgcattttattttattttttattttataaaatatttcctgcatataaactttgtttttttaattaatggccacagtaatattctaacacaggaccactctttgtgggaaaaaacttaacagttatttttagaatactaagatccagggttcaaaaagaaaagtacatggttcaaaattataggacagtgactgagaaattaccattaaagaagaatttaaattattcagactacagagtgaacattttctttctttctttgcacaaaatcctgaccaacaaattcacccattggacgtaagtgctacccatttatcagtgatatcctactcatttgaccagggtgtggcaaggttttcatcattaagtactgaaaaaagtaggcatttgctctcaattgaagcattttctgtgacctcaaggacattttagatatttttaaaaattattcttcctaaaaacgtacccctttcatgttaattaagttaaatgctttttatatttacacagttattttaaaagtttaatgttttatacatagaaatgaatatatgtaacacagatggaagttgtagtgataaaataaacatgaaacaccaacccaacttaataactaattcattaccaattctgttgcatctttttgtaccactaaatcatggcttaatcatttctggtaatcataacatttgtatttattccaaactctataaccttacataaagcttattttattttatgacataagaactgtaattgccagataatgagcatctttagatggaaaaaagtgcacaacacaatagcactttgagaaagctatgtattttataagcataggaattttattattccattaacacaacttctggagtaactagattaatgaatgtactggttttcaacaaaggagatcttaaccctaaatgattcaatctttttcactctacgaatatataaagcctgtaatacataagcaagacctgcagtacaccaaagttttgtctagttggtctttcaaataaagaggtgaggaataaattatactggaatagacttgagggcatccaccatgttaaatgtttattttagtatctcataaatagccgtgaaactttccttatgaatgttatacatgcatacctcactttattgactttgcagatattccttttttttttttttaacaaattgaaggtttgtggcagtcctacattgagcaagtctcttggcaccatttttccaacagcatgtgttcctttatgtctctgtgtcacattatggtaattctcacaataattcatactttgttatttttatatctcttacagtgatctgtagtcagtgatctttgtttttactactgttattatttgggggcaccacaaattgcacccattataagatggcagacttaatcgataaacctgtgaattctgactgttttgccaattggctgttcccttttctccctctccttgggcctccctattctctgagacacagcaagattgaaagtaggccatttaataactctacaatggcctctaagtattcaagtgaaaggaaaaattacatgtctctcattttaaatcaaaagctggaaatgattaagcttagtgaggaaggcatgtcaaaagccaagagagccagaaacctaggccgctggtgctacagccaagttgtgaatgcaaaggaaaagttctttaaggaaattaaaagtgcagtagaccaacattcccttaagccaaagcgtaatccagagcaaggccctaactcttttcaattctgtgaaggttgagagaggtgaaaaaggtatagaagaaaagtttgaagccagcagaggttggcttatgagctttaaggacagaatacatctccataatataacaatgcaaggtgaagcagcaaatactgatgtagaagcaacagcaagttatccagaagatctatctaagatcattgatgaaggtgactatgctaagcaacaggttttcaatgtagatgaaacagtcttatatataggaagaagatgccttctaggactttcattgctatagaggaaaaattaattcctgtcttcaaagctttataggacaggctgattctcctgataggggctaaagtagctggtgactttaagttgaagccaatactcattggccattctaaaaatcctagtagctttaagaattatgctaaatcttccctccctgtgctctataaatgacaaagcttggatgatagtacatctttttgcaggttggtttactgattatgttaagtcttttcttgagacctcttattcagacaaaaagatttctttcaaaatataactattattgatattgcatctagtcatccaagagctctgattgggatgtacaagattaatgttgttttcatgcatgctaatacaacatcccctctgtagtccatagatcaaggagtaatttcaatattcaagtgttattatttaagacatacattttataaggctatacttgccatagatagtgattcctatagtggatctgagcaaagtaaattgaaaactttctggaaaggattcaccattctagatgtcattaagagcatttatgattcacgggaggaggtcaaatatcaacattgacaggagttgaaaagaagttgattccaaccttcatggatgactttaagtagttcactgcttcagtggaagaagtaactacgatgtcgtcaaaatagcaaggggactagaattagagatgaaacctgaagatgtgactgaattgctgcaatctcatgatgaaacttgaacagataaggagttacttcctatggatgagtaaagaaaggggcttcttaagatggaatctactgataaaaatgctgtagacattgttgaaatgatgacaaccaaggatttagaatattacataaacttagttggtaaagtagtgacaggatttaagaggattgactccaattttcaaagaagttctactgtggattaaatgctgtccaacagcattgcatgctacagagatatctttcatgaaggaaagagtcaatcagtatagcaaacttcattattgtcttattttaagaaattgccacagccaccccagccacaagcaactaccacccagatcagtcagcagccatcaacatggaggcaagaccctccaccagcaaaaacgttacaactcgctgaagactcagataattgttagcattttttagcaataaagtattttttaaattaaggtatgtacattgttattttcacataatactatttcacacttaatagactacagaatagcgtaaacataactcttacatgcactggctaaccagaaaattggtgtaaatcactgtactgcaatactcagtttattgcggtagtcttgaactaaccctgcaatatctctaaagtatccctgtaattcactttaaagtttttttaatgatgtagagactcaaatctgtacatgcttcacctttcatagtaaccctcttaatccttagccttagttaatattgttcctactgatggtcattttagcagagtaaatatatgttttgacattgccttttcagctcttttggtaagcgcagtgaatagttgttatgtgaaaaaagatcttacagtaacctctcacatagattatgtataatggtggcttttaaatgttgcagcatcaatgccgttacaatgggcatgagtaaacttttgaagaatttataatcaatagcagatggatttatgtccacattttatatttgaaaggcttaggtagtatgttttcctttcagcattctattacctaccacactctttctccactctcgattcatataaatgataaatcttggttagccaaagtgatgacaaggaatcaatttcctggaccactgaacttagagctctcccttaactttctaaaaagcctcttagagctaactacacagggaactttataactgtgggattattttgataagtgactttgagaaattagaatgcttttcactcttatatccaaaagcctttcagttcttctaacatcttaacttggacagtaagaagaaagtatagacagtcactgacttgtgataatttgacttgtgggttttgttttgttttgttttgttttgttttttacttacaattatgtaaaaccatcacaatttcaacatacttcaaattttgcattttgatatttttgtggtctgttgatatgtagtacctgagatattcaacactttgttataaaataggctttgtgttagatgattctgcccaactgtatgttaatgtaagcatcccgagcacatgtaaggttaggcaaggctaggctctgatgttcactctcttagctctatttgaatgcatttttgacttgccacatgttttcaacttaaaatgcgtttatcaggatgtaacctcattgtaaatcaagaaacatctgtattatctgtgtcagaataaatgcccaaccaaacaaattaactattaattttcccctttagagaatatatttgagctcaatgctcacaaatcatacttaattttagacatagttccctgtctttatttttcttgtgtgtatgtccattgtcagccatttgaatcgataaagactttttctaaagataccttaggccagtcatctcagttttaaaaagccagtactccagctagtggggaattcattaatcactgttatcatatggaaaactgaattttatatgtgtactactaacaacataaaaagactaccctttttgatccaaccagactgccactgttatcttgcagcacaagtaagcatggcacacaaaacaatgtatcagccagtctttttccactctttcttcttgtctaccgcctgagatcacttaattgtatatgtggcccagggtgcccagtgttacatagccttgcctttaagatttctgacactctgtagaatccgtaaatatgcatgtgtgtttatggtcttcatcttcatcaaattgaagacattattttacagaatttatgcaatacaatatgtggaagaaagtagaacagaataaacattgtctagtcagaccatgaaagcaggaccatagcttcttggcacacagcctaaccttcagcaaaatgaaatgctcacagcagtctgtgaaaagctgcaaattcccgacatcaaatgttcctaagcaagcatattagttatattaatcgcctattgggaaagccatcttttgcttattataaatggggctcttcctggaatggggcaactggtaaaaggaaattttgcttatgtttttctgaaattacatttttcagtaagccctttggctcccactgcttcagctgctcactgctgtttctctaccaaatgctaaacttaaaacagtcataatatccaggtgagaagttactgctccccggttcccatttaagtttgaagccttaggatacctttctaaaatcacaagcacaagttttatccaacactactgcttagcttctacctatgggcaaagggaagggatggtttcacatctgtgtaagtatctgtacgaatgcaagagagacagtcccatgtggttaagtaatttgcagtactattatattctctttacattccaaatggatcatttggcttgacattgaatgaagtctaatactgactggttggaaaagctagaaaattgtttagtcctaaactttaatgagagatacggatatagcagcttgcagagaggtatatctggcatttattccttcaagattccttttgtatctgctgccgactgggagcccttaccattttccacttgattgcctatttctctccatatttttttcccttcccttaagctctcagaccaaaacttgaggtcatgcatgcttttctctttgaggagacttaaatctttgctgacaagttgactttataccaactccaaaatcaggactaatccactagggatctaatttaccttaaatatagcaaccactatatatagcgtgagttcaaaataaaaagctggttggttatatatattgtaaattttatattaataatattaacaaaagaccagatggtatatgtgtgctataaatatgactttcctaaatatcacatatagaaatgaaatatgcttctttaaaacaactcttgtacttgcctttaaaaaaaattatcaagataaaattcaaagtattcagtgtttttagtatattcagacatgtgtagccatcaccacaattttagaagatataattcatatgctatacaattcaaagtattcagtgtttttagtatactcagacgtgtagccatcaccacaattttagaacattttcattaattcaaaaagaatgcctgtcccttttagcaatcatcctcctatcccctcatcttcacatctagccctaaataaaccactagtctacttcctgtttctataaatttgcctatttgggacatttcatataagtaggatcatataatacatggtcttttgtaactggctttttccacttagcttaatattttcaagattcatccatgttacagcatgtatcagtaattcattcctttgttgtggtggtaaaaacacaacacaaaatttatcatcttaaccatttttaagttcagcagtgttaagtatattcatatttttgtgagacagatcttcagaattgtttcaattcgcaaattcaaaactctctatccattaaataactcttacacctccctctagcgtctgataactatcattctacttttttctattaatttgactactttaattgtttattcattcacctattaatgaacatttgagttgcttccacctcttgactattgtgaatatagtttctatgaccatattcaagaccttgcttttaattcttttgaatacatacccagaagtggggttgttggatcatatgatagttctatttttaattttttgaggaacttccatactattttacaagtggttacaccattttataaccccaccagctgtgcacaagggtttcagtttccttattcatgccaaaacttttctgggttttttgatggtagctatcctaataagtaaggtgatgttctcattgtgattttgactttcatttttctgacaattactgataatgagcatctttttatattctcattggctatttgtatagcatctttgggaaaatgtgtattcaagtctttttttcattttaaattcatgtgattttttgttgttgagttgtaagagctctttatgtattctggatattaactcttactagatatatgatttgcaattattttctctcatttcataggttgcctttttactctgttgattgcattctttgatgcacaaaatatttctgttagatgtagtcccatttgtctattttgctttagttgcctatgtttttggtgtcatatcccaaaaaaaaatcattgccacattgaatgtcatgaactacttcctgttttcttctagttttatagttttaggtcttacatttaggtctttaatgcaggttgagttaattttctttgttgttgtttttttcactgtcttcttcttattattaatttccataggttattagggaacaggtggtgtttgtttacatgagtaagttctttagtggtgatttgtgagattctggtgcacccatcacccaagctgtatacactgtacccaatttgtattcttttatccctcacctgcctccgaccctttcccccaagtccccaaagtccgctgtatcattcttatgcctttgcatcttcatggcttagctcccacttataagtgagaacatacaatgtttggtttttcattcctgaattacttcacttggaataatggtctccagttccatccagtttgctgcaaatgccattatttcattccttttttggctgaatagtagtattctgtggtatacatataccacaatttctttatccactcatggattggtgggcatttgggctggttccatatttttgcaattgcaaattgtgctgctataaacatgcatgtgcaagtgtctttcatgtataattacttcttttcctctgggtagatacccagtagtgggattgctggatcaagtggtagttctactttcagttctttaaggaatctccacactgtttgccatagtggttgtacaagtttacatttctaccagcagtgtaaaagtattcccttttcaccacatccccaccaacatctattattcttttattttttcattatggccattcttgcaagagtaaggtggtatcacattgtggttttgatttgcattttcctgatcattggcgattttttttatatatttgttgaccatttgtatatcttcttttgagaattgtctattcatgtccttagcccattttttgacaggatagttttttcatgctaatttgcttaagttcctcgtagattctagatattagtcctttgtcagatgtgtaaattgtgaagattttctcccactctgtgggttgtctgtttactttgctgattgtttcttttgctgtgcagaaactttttagattaattaagtcccacctatttatcattgtttttcttgcatttgcttttggattcttggtcatgaagtctttgcctaagccaatgtctagaagggtttttctgatgttatcttctagaatttttatagtttcagttcttaggcttaagtccttgatccaacttagttgatttttgcataaggtgagagaggaggatccagtttcattcttctacatgtgacttgccaattatcccagcaccatttgttgaatagggtgtcctttccccacttttatgtttttgtttgctttgtcaacgatcagttggctgtaagtattggatttatttctgggttctctattctctttcattggtctatgtgcctatttttataccagtaccatgttgttttagtgactatggccttacggtatagtttgaagtcacgtagtgtgatgtctccagatttgttctttttgcttagtcttgctttggctgtgtgggctccttttttggttttatatgaattttaggattgtcttttctagttctgtgaagaatggtggtggtattttgatgcaaattacattgaatttgtacattgcttttggcagtgtggtcattttcacaatattgattctacccacccatgagcatgggatgtgtttccatttgtttgtgtcatctgtgatttctttcagcagtgttttgtagttttccttgtagaggtatatagtataattgtaagagtccaattttattcttttgcatttgggtatctgattttactagcaccatttgttgaagagactgtcctttccccattgagtggtcttgacacccttatcagagatcatttgactatacacatgaaggtttatttctaagttctctattctattccattgatctatatgtctgtttatgccagtaccatactgttttgattactgtggcttcataatatgttttgaaatcaggaaacatgactcctccaactttgttctttttcacaattgttttggctatttggagtcccttgagattccatataaattttaggatgagtttttctgtttttataaaaaatgtccttgggattttgataggattgcacttaatttgtagattgctttgggtagtatgaacattaacaatatgaacacaggctgtctttccatttacttgtctctgttacttctttcagcaatgtttagtagttttccaaaaatacatcatttctttttatggctatgtaatgtttcattgtatagatgtaccacagatataccacagtttgttcattcatcagttgatggatatttaggtttccatcttttggctattatgaaaaatgatgttaaaaataattatgctcaagtttttgtgtggcatttgttttcacttattttcagtttgcccttggtttttaagaataattgaacttaaataaaagtaaagactgttctggaagtccaggatagaaaaagacattttgagtaagacctatatttgttgctttgagtagacacaaaggaaataaaaattgcaattctttcaaaagcttgaggaaccacacacaccaacgtgagacctcttacatgtcaattttgcaaatagttgctaactgattgatagtatttggatctatgcccccccccctccaaatctcacgttgaaatgtaactcccagtgctgtgctggaagtggggcctagtgggaggttactggagctgtgctgtcatcatgatagtgagttctcttgagatctggttgtttaaaagtgtgtggcacctgccccctctctctcttgctccttctctggccatgtgaggtgccactctccctttgtcttctgccatgattgtaagtttcctgaggcctccccagaagaaaaaagccactatgcttcttgtacagcctacagaactgtgagccaattaaacctcttatctttataaattacccagtctcagtatttctttatagcagtgcaagaacagactaatacactgatatattacaaattgaatatatagttgacaaaaaatatatacatgagtagtattcagagtggcaatgatcaaggagaacttactatcttgaatgaagtcttgatatagataacggatgtagactggcagcaaaaaggaaaataacagtctgggtttagggaagccttgaccatatgcatggaggtgagcaagtatatacagaaacatgacttggctagagagggggtacagcttcaaagaaatgagattagagattagcaaaatatccttctctattttatatcctctttgatcgaagctggttgtatttgattgatatgacctttttctctacttatctgatattttcttgtagtcataatcattaatgcactcattcattgactcagtcattcaaacagtgactgagtgccttttacataccaaacactgtgcttgatactagggttacaaagatgaatgatatatactgtgacaacaaagaattcaaagcctgatgcagaagtcaagacaatttcacaaacagccacaatacaatatgaaaagtgtgcaaaaatagatggttacaaatcttatgcaaatattaagagtaaatgtagtccttccaaccaattctctgttttatcaccaaagaagttccaaaaagacaaatctcattacctttcaagagacttaaattatgctagtaaattaacttgaagtcattagtctgcttaaaaatcccttattggattcccatttttacaaaattaggtttaaactcccttgatcctgtttcatttgtctaaaacgcccccctctcctacctggttttgagttactctttaaaactcagctcaggtgtttatctcttctaggaagattttctagatgttccacaagtttttggttaggtgattttctgtatgtctcccatatcaccctgtacattttcctgccactgtctatgtcatactatcttgtaatcatctctatttctctgtctttctctttctctcatgcactgtgcttgtgaattccttgaggacatcagccaggccctacgggtatttttgtctccagtgtctagcatatattatgttcccagtgtttgatgaatggatgagcaaatcagtcagtgaacttgttggccttggtaagagacagaagatcaaagaggtaacatctgagctgaaccttgaagaatgcatgatacttactaggaggagaaaaaggaaagaaaaaaggccttcctgtccaatgcaacatgatctgcaaaagcacagactagaaaaagcccagaatgtttaagatgtgacaaatcatactttgtatcagaaactggacatttgtcagaaataaaggtcaatcgcagtgtaaatatttcccacattgtgctaaacgattcttaaactagcactgcagaattattataataggatatgtttattaatttttagcctactaaagttttggtgggttgtagcatttaaataactacattattccttgtcatacatacatttttctcatttgagcctcctcagaaacttgagggttattttttagtatttatgtgtatgttagaatggggagtaaatattattgcaaactaccagaacaaagtttttagattccagaatcaaatgttatcaaattattattgagtagattctataccataggaaccttccagaatggaattgcacaataagatatatgaacaactcaggcattcaagacagaaatcaagtgagctgatattcttttatccaaattgtcagtgagaccttactccactttcttctacttccacgtatctaaatcttgcaaaagcagaagataatcattatttctctcctcagagtggtcaaataattcattcatgtgcatttcaagacactgtgagatctataatacagctgtcagtatcaactgtctttcaaacttagcatattaaatataaagcccctgtcttagaatataggaagaaagagagccatgctgagcctgtttctttggggctactggcaagaacttagggtgtaaaagtgactatactaactgttgattcttatggcaaacagatttgtagttttttgttgttgatgatggtgtatgtagtgataacatatacataacataaaacttaactattttaaccatttttaagtgtatggttcaatagcattaagtacattcacattgttctgtaaccatcaccaccagccatgtctagaactttttggtcttcccaaactgaaactctatacccattaaacactaactcttctttccctcctcatcccagcacctgccaccaccattctactttctatctctgtgatttgactactctatgtacctcatgtaagtggaatcataaaatatttgtctttttatggtcagcttatttcacttagcagaatgtcctcaagattcatccatgttgtagcatagtcagaatttccttcctttttaaggctaaataatatttctgtatgtatataccatactttgcttatccattcatctgtcaatggatacttgagttgcttccaccattgattattgtggataatgttgtgaatatgggtgtacagatacgtgttcaattcccagcttttaatgttttggatgtatacctggaaatggaattgctggtttatatggtaattatgtttaattttttaacttgcaactttttaaatgtgagagatataaaggaagagcagtgggtagagggaacatgagtggtagtagttattactatggtggtagtatggctgaaaagttctggtcgggcgcggtggctcacgcctgtaatcccagcactttggaaggccgaggcgggcagatcacgaggtcaggagatcgagaccatcctggctaacacggtgaaaccccgtctctactaaaaatacaaaaaattagccgggcgaggtggcgggcgcctgtagtcccagctactcgggaggctaaggcaggagaatggcgtgaaccccagggggcggagcctgcagtgagccgagattgcgccactgcactccagcctgggcgacagcgagactctgtctcaaaaaaaaaaaaaaaaaagttctaaaatctagtttttccatcttactttagccacctatgaaatatattgctgtgggtaagtacttactgtatttaaacgtctcttccggccaggcgcgtggctcacgcctgtaatctcagcattttgggaggccaaggtgggcggatcatgaggtcaggagatcgagaccatcctggataacacggtgaaaccccatctctactaaaaatacaaaaaattagccaggtgtggtggcgggcgcctgtagtcccagctactcgggaggctgaggcaggagaatggcgtgaacccagaaggcggagcttgcagtgagccgagatcccaccactgcactccaacctgggcgacagagcaagactctgtctcaaaaaaaaaaaaaaaaaaactctcttccttcacctgtaaaatgaacataacagtgctctactagattttcatgggattaagtgagattatatatgtgattcatacagtgttaataaacatttactgtatcattggggctagccaccagaaaaactcagcccttgtgctatctctgataattaaccactattagtgcactattcaaaatcccagcaaagtcattcatgtagattctgagctgatgtatagcttacattttgatctacaccccccagtgccaggacaaactacttccagataaggaaccatcccatgaggtttactgtgatcctggacaagcaccactgggcccactgctagggactatatagcttcaggttcatgtgagagttaatgttatatatgtgaatacaaactagaccctatggtcccaccactttgcttgtctgacatagtatggcccaaacctccagtatagctccagaatagcttcaacatcctaggagtatctgaaggtagaatctgctaagttctcccttccaattcaggtgccaaaagggaagagtcaatatcactataggatatagtgatattcagaatagaaatttgaacatcagatggtccgaatataaatttaaaaatctctctacacttacttctaggtcctaggatctggaaatcagagaccctaggtggctaagaaggtcaaagataaaaaacacagactcacttatccagctccggaaacaatgaaattttataaattatacaaatacttcatgtaaatcaagtcctatattacttgtcttggtttcttttcttccttcctcttcctctttttttaacctcatttatttttgctttcctttttttaaattagcaataaagacagtttctgactagaggatttcaggaattggttatgactcctgaaacttttattcttattggcactagttcaaatttctgagccaaaagtgattttcatccagagtagtctgaatacttacttcacacaaaaggttactagtgctcttcttataggcactaaattatttcaattaatgaagccaaaatcaaaggctaaaactcaaatggaatgactgggatattccttcctttttttttaagctttctcttcttaagaaaaaaacaactttaggattaaaaaatgatgcattcattgtagaaaacgtggaaattttgggaaaagtagagcaaagggaataaaaaacataaatctaacattctgaagtaataaatgctttatattttcatgtatgttctttccttttctactgatatatacacatatatcttaatacagttaagactatatgctgcagatttgactttgcatgttgtaaaaatatgtatcataggaattttcctatgtcaatgaatattcttcataaatattactttagcctccataatattttaccttaagaatctatcatttcttatttaagtacctatattgttgatagtttggtttctttccattttttctattgtaagcaactgtgaaataaacatatacagaaacatttatccattttcctacgatagatttctagaagtgaaactactaggtcaatgggtatgaaaacgtttaaagttggctttccttttaaagaaaatcatatttgggttgttaaaggattactgacacatcaactgagcacatctttgattactgtatagcacctcatattcagataatctctgcaaacattgccatgaattgactgagtataatcttttatttcaggcaccagaatgcatctcttctatctcctgtttcttgggacagaaatcaggagttctgactgagcccatttacaagctgtgtcagacaagcactcatgcccatcttgtttatgactgcctgcttacccattgctctccatatttacattttccttcttttctcttccttcagatggaatggggcgagtccttgctcaagatgtatatgcaaaagacaatttaccccccttcccagcatcagtaaaagatggctatgctgtccgaggtaaatattttggttttcttaaacataatcaggcactgtatttttttttctttttttctttttttttttttttttttttttttcaaatttttggcttagcccaagcacccagcaactgttaggtttgtttccccatgactgtcaaaataacttcattcacagataaccatgttaatctgcacctgtaaattttctggcacaatcttgattaaaacttttgaggtaaagaaaagttacatgaaaattctcgttttaaattttttatttttaatatttgtggatacatggtaggtatacatatttatggggtacatgagatatttagatacaggcatacaatgcataataatcacatcagggtaaatgtggtatctgtcacatcaagtgtttatcctttgtgttactgaaattcttggctacaaataaatatataggaataaaattaaaacactgtacttcaatttattctttccgttcctacacatgccagacagcatacattcttagtgtgaaagttttccagatgttttctagttgaaaacatctgatggtctaagaaaaaagagcagattcccaacacaaggataaagttgaggtggtctgttctgctttcaactcaaacatcagtaaagggcttcatgaaaagcggacatgagggaaacctctaattctctagaagacatcatatttcaaaattctggcgccccagcagctcacacaaagttgcctgagattgcataaagcttaaaagcaaatactaaatagcatttttctgcctaaattccaatctaagaaccccaaatgtaaattctgaattgcttagaaactgttgttgatttttttggttttgtttttgtttttccatgtacaacatgatattttaaaatatgtagtacacattgtagaatggcttagttgagctaattaacacatgcattacctcacatacttatcatttttgtagtgagacttaaaatctactctcttagtgattttcaaactatgatacattgttattatgttattggttattaattcaaggttgatatcattgaagaaacatgtttaaaaagtttttcagtttatcagagctgttaagcatgccaattcctttttaatggggtacatgagatatggagttatggagtctcttacttggttttggttttggtttttttagctacatttagccatgaaaatacaggttgggcatccctaattcaaaaatccagaatttgaagtactccaaaatctgaaattttttgcgtgttgacatggcaccacaagaagaaaatttgatacctgacctcatgtgaagggtcaccataaaaacacactcaaaactttgtttagaaaaattatttgaaacattgtttaaaattacctaccttttggctatgtgtataggatatatatgaaacataaattaattttgtgtttagacttgggtcccatccacaagatatctcattatgtatatgcagatattccaaaatctgaaaaacatcaaaatccaaaatacttctggtcccaagcatttcatataaaggatggtcaacctgtaatttcctttttcctgtaattaaatacttcattaatctcctctgtattccatcatctcttagtagttatctttttatgttggagatagcatagcaaatgattaaggctacaggcattgagcaaagctcaagtgatctgggttttagtaccagttccatctgtgtaactttgagcagctcacttaaattttttagcttcagttttcttatctctaaaattatgataattacaacaatacttaccccagcaggttgttgtaagaattatattaaaaattaattgtagaaattaattagttgtagaaagccttagtaaactacctggcacacatttaaaaaaaaaaacacttgataattgttttttaaaatatttaatgatagtaaccattattatcatattataaatacattttcttaaactatctctgaaaaatggctaacatttgaattgctactctcattttctgtgtaaataaaatggtagagagattgagcttatgttttttcatttccactaatgtattctttctcaggaagattatcttggattcacttcattcagcttgatctcactagattagaatacttctgaaattggcaaagccaaaacttaaataccaaattcccaatggctcctatgtttttttctttcaaattgattccttctacagtgttgattagaataaatattatccagacagaaaattattttattcttgtgatagcttcactggctcttctagtttcttttttttttcccaatgtcattgttggcttgaaatagtttcttattgcccatctaaaaagtaaattctgtgttgatcttacaatttgtagccatacaggattactataaaatgacaaagaattcttacttccagagtagagcaaacagctacagtagatgaaacaccagagacaaagaagtctgttttttatagtctttgtaacataatgtgggagagagtgagaaaataaattatttgaggcagaattattcccaaacagaatattgttctgtgatttttacatgagctagcagcagctcaattaaaaaaaaaaatggttgctgttagcttttcttgttgccaaagggagccattagcccttatgagcttttctgacactgtacaactcatcaaaaaatttttatgtaaaattaccatttagtatcctatttatgcttttgtttgagaggtttttttttttgttatttcaccaaaaaaaatctaaaatggtatctcacattataaacagtccaagagattatctaccgtgaagctgattcacattgtttctttcttgcaaagggttggtacttctccaagatatgtaacatataagagcgacataagtgataatcattgcataaatggttaaatctcaaagtaggaatggttagtatgtctgtgtatacaatatgaacatcataattaaagaagcaaaagtcttctgtagacaagtggcatggtcttagaactatgctgaattttccagtttatacctcctcacttttttgtctgtaattcaggaagataaactctatgaatcctaaaagtgatttttactgtatttagtaataaagatgattttcatttctttaaaggtaaatgtattcattagcctcttttctgttataaataccacccccaggcagtgttttggtaaagaatatccttgaggccaattattgtggctaagaccctcctttgagtacctccttctctctacccctgtcttcctttactctggttcctttctccctgctcccttgattctccctattttcttctcctctgcctttaccttaggccttccagtaataaccagtggcactcgtgggcattgctaaccctctaggtgtaaagatgttgctaacttgctctggatcactaagcattagccagtatccttcagaaacatgtgggataaaactccaaaccagttggaggatcacttgctttaaggtatgtgagttcaaaaatcaagacagtaataaaatgactaaggaaataagtagaaacagctcaaaataaaacattaagaaagaatagaatgtaaagaaggcaggaataaagtaatgataatataaaataataggaagacctgtaaacctaaaactgcattcacgtgggagtgaatttgaaagataaaagtagataaaataaaaatgaaagtggcatatttacaatttgaatcaatacagtatttttattcttcacatttttcgattttgtttctcccttcacactgatgaagctaatcatcctcttgatgcattcacatcctcctatatagatgtaggtgactattttatcacactttctttgtggatattaataagggcaaaaatatgttagaactccaagttcagctttcttgaaaaagttcaatttgaaaggtttatcccttcagagcttattttgggatcatttggaaaaaaggaatattttgaacaaaccaggaattattttcagagtcataggtaacatacagttctgaaaagatatattaagagaaagttttgccatttgggtagagagaatttaaaaatttttttttcttgtttacattctgattgaaattacttatgaaaaatgcaaaaataatgaaaaagaacattttaaaattacccattaacttaccccctggccactattagcattttgtgcatttacctcacatacagtgggttagaatacaccaaaattcaatatagacaatccacagccattgtgacttagacctagttcttattctttcaacagtaatcatatttcagggcttttgttgtatccatttgaatcctctttcgctacaactggttctgcaattcatttgacagcctattttgccctctactataggatactttcagtgaaaaagagggccttatgatatgggagtaatactcatgtgaatagataaataatttggaataatttagtttagttaattccaaaaagaaaatatttctgaaaataatgccttctttcccaatactaacaattaataggcattttccctggaagataatggtaaagaatacacgatgccttcttactcatgtatcctatgcccacctccctgcgttccataggaaaaggtagccagtttaaaattccaaacaatttacctaatgtaatacttgagtgtaattgcagcaagtatgaatcctcttattccagctttgtcaccttctcttgttacctttccctaccaacccctcctataatcttaactttagtatgcatataaatactattaccctgtgcccttcttgcagtctcagacagtgtagttctataagcagagcagacaaattactattccttctgccttatttctctatcaactatttcctaggacctctgaaagttatgccatctctatgtgctctaatttgttcagccttaaagtggaaatgatgagactctttagtattgaaaataaatgactagctatacagtatttcaagagacttaaagaaagatcactatggctggaaaatgaaaatgaaggataattccatggcagatgatttgaagatcatcgttttctgtgtacacaatgagtagttatctagtgttatcaatttcatatcaaataatataaccagaaatcttcaaataaatgggtgaacagaactaaaagtgttttctggatattagaaaaaggaggaataagaaggaacagcttcagggtcttgcattaaacattaattgtttacataatgcatatgccattagggtttggtttatattgcttttatcacttctttcaaattaaattctacagttgcaaagcagaaaagaaattcattagcagatatgtcagaattacaagggaaacaattctaaatctgcagaagtccttcaaatctattcatcttttctaatgacgtactgtggtttactttctttttttctttccaagctctaggttcatgtgctatcatgcctccgcttctgccctctcctacctaaacttgtagaattcatcttgaaaaactgcaactttttaaaacctgtttctttcatagatatttttaaataaatatagccatgcaccacattagcatttgagtcaaaaacagactcttacatgatggtggtcccatgagattacaatggagctgaaaaattcctattgccaagtgagattgtagccattgtaaggtcacatagtgcaacacattacctttcctatggttagatatgtttagatacacaaatacttaacattgtgttacagttgcctatagtatttagtattgtaacatgctgtacaagtttgtaacccaagagcaataggctataccatgtagcctagttgtataataggctataccatctaggtttgtgttagtacactctgtgatgatgttcacacaacaaaattgcctaacaatgcatttctcagaatatatccccattgttaagtgactcatgactgtatcaggaagttagatagattgatacttatttttctgtcttcataagacaaaccttggtgttaatgtaaaatttggactcctgtagttcactaatttttttattccttaaattttctcttagtctgaatttgtctatattcagtttgatcttatagtgctctgctcctcaaaaagggtaatccatggaccagcagcctcagcatcagcttgttagaatttagaatctcactgttggtgggactgtaaactagttcaaccactgtggaagtcagtgtggcgattcctcagggatctagaactagaaataccatttggcccagccatcccattactgggtatatacccaaaggactataaatcatgctgctataaagacacatgcacacgtatgtttattgtggcactattcacaatagcaaagacttggaaccaagccaaatgtccaacaatgatagactggattaagaaaatgtggcacatatacaccatggaatactatgcagccataaaaaacgatgagttcatgtcctttgtagggacatggatgaaattggaaatcatcattctcagtaaactatcgcaaggacaaaaaaccaaacaccgcatgttctcactcatagatgggaattgaacagtgagaacccatggacacaggaaggggaacatcacactctggggactgttgtggggtggggggagcagggagggatagcattaggagatatacctaatgctaaatgacaagttaatgggtgcagcacaccagcatggcacatgtatacatatgtaactaaccggcacattgtgcacatgtaccctaaaacttaaagtataataataataaaaaaacaaaaaaaaagaaaagaaaaaggcaaaaaaaaaaaaaaaaaaaagaatttagaatctcagaccttgtcccagccctactaaattagaatctgtatattcacaagatctcgagatgatttgcatgcacattaactgttgagaaataagagaaataagaaaaatgactcctctcttggtaccaagaaacttctatgtagttgtttgactgattcttccttagctagcaatatagagacacatttaccaactggaaaggttcagagtaaggttgagaacatagtgcaagtgagcacatattctctccacaattggtatactttccctgataacaaagaccttgctccttagaatcgcttcagagtactttcacatatggacctccctggaactccatactaggcttgccccagatgacctccccagatgacctccagctactcattattcagtttatttagaggattatgcagaatattgatatgagcattttgagtttatgtgcatgtgtgggggaacaggagaaaagagaaatacttcccaccaaaaactttttgagaatgccaacttcatttctttattcttttaacaaatatttattatcagcgatgacttaggcactatgctagacagaataatgacataatctaagttatacagaattaatcaaagcagtctttttttttttttttttgagacaggatctcgctatgttgctctggctggagtgtagtggtacaatcccagctcactaaaacctccactccccaccccccacccggttctcaagccatctttgtgcctcagcctcccaagtagctagactacaggcacacaccaccacacctggctattttttgtatttttgtagaggtggggttttgccatgttgcccagctttgtctcaaactcctgagctgaagtgatttgcccagccaaagcagtctttctaaacattcttaagatgttgactcaaattttgaaggaaacaatatatatggatcagcaaaaagtatatataacaaatataaaactttgtgttagaaaatattacttatttggtcattcgtgcatgaatcttctaagaacgtttttgtagccacattcattcgtctgccaaccatttttgaatacttaacatattgaacatttatttaacacctattgtacagcaagtgccagggattagcaaatactgtaaatatatttagaagccataattgatttcaggctacactggggaaacaaaagaggatgcacgcaactcttgaggggagaggagtcagatatgacttcacagagaagatgacacttgagctgagtcttaacagctaaaaaatctttaatcagaaggcaagaataagaaaaggacgctttaagtagtggaagtagcacatgtcacggagccaacatatgagttatcttggtattctcagggatagtactagcagttgataatagctagagtataagatataaggaagacatgaaccaaggcctttgcacatatgttctctttgcacacaatgatggagcacttccacttcatgtctatcttttcctctctctccctctccttctttccctccctatttccctccctttgtctctccccacctacatacctgcacacacacacccctacttagctcttactcattcttcatattcaaatcagaaatccttttatcatgcttttcatgactctccagtgtagctcaggtactttaattatatactctcataaaatcatgtttctttgctttggagtggttttcttaatttgtatttatatattcattaatgtgattatttgattaatatctgcctctcctgatgcatcagtggctttaagagttttattttaaccacacccatgggaagaaatacattaaatatattatacatcaaaagccaatgatatacacacacatatataacatatacagtacatataaatatacatacatacacgtatataaacaaaaataagttttatgaaacaagagtcatccttaccatgtgtgttgaaatatatttttatccttttcattagaaaattgttcacaagttgattttacagcctatctccatttgtcatccagagtttgaaaaaccttgtaacacacaccatcatggcacatgtatacatatgtaacaaacctgcacgttgtgcacatgtaccctaaaacttaaagtataataataataaaaaaaaagataaacctaacctggaaaaaaaaaagacaaaccttgtaacaggttggcactgcactaaaatagaagcagcgtctaggtttaccccctactctctctccagcccttagtttaacacttggggcataaaagacactcagtagacatttactgaatgaataaaaggaataaagagcttcaaaggtattgttttaaaagtgtgattatccccatttttaccaacaagaaaactgaaggtgagagaggtttagtaattttgctgagagtccctgaagctaacaataaacagaaccaggattcagattcaggtttttttactctaaaacaatgctaatttcccccttgtgcaggaagtaaaaaaaaagaaaatgggtcaggcgcggtggcttatgcctgtaaccccagcattttgggaggccgaggcaggcggatcacctgaggtcaggagtttgacaccagcctgaccaatatgatgaaaccccgtctctactaaaaaaataaaataaaatacaaaaattagccgggcatggtggcatacgcctgtaatcccagctactcaggaggctgagacaggagaatggcttgaacgcgggaggcagaggttgcagtgagctgagattgtgccattgcactccagcctgagcagcaagagcgaaactccatctcaaaaaaaaaaaaaagaaaaagagagagagaaaatacctaggttgctataggaggtagcaagctgataattatttatctagtagagaaacaattttaaataagtttattcacgtttgagatgcagttggtgtggaactctgaaagataattgatgttttaattttctacagtaagaaaattatcatttgctctgaaagatggcaaaaataagtggggggatagatgaaacaagattggtaaaatgttgataattgttgaagcaatgacgtctatgtctgttgtaaaaacttttttttttttttttgagacggagtttcactcttgttgcccaggctggagtgcaatggcacgatctcagctcaccacaacccccgcctcgcaggttcaagcaattctcctgcctcagcctcccgagtagccgggattacaggcatgtgccaccatgcccggctaatttttgtattttattttgtatttttagtagagacgaggtttctccatgttggtcaggctggtcttgaactcccgacctcaggtatctgcccgcccgggcctcccaaagtgctgggatgacaggtgtgagccaccacacccagcctgttgtaaaaacttcttaaactttaaaaaaaaaataacccatgaaaatggcttaataaaataacattacaataaaactcttctataatactttttacaagtaaaaactgaacaatgtaacaggattcaaaaaaaaaaacacaagaaaggcaagagtttattaactgagataatatctgtaaagcataaaatacaacatcctgtgacagaagggacccagtgttaatttttgtccctcttcacatcaggctaaccaaagccatttatgcaaaaaagggatgacttcattataaacggtgttttatataagcctttagaaaaaaataacactttatagctacataaacgagcaattaatctaatgtccttttaaaaagagaaaatatcattattagtatgattataaatgtaatctaaatattcatatataatgtatatattttttgtagatatgctcccaaaactctgctgtttgcagataacatgaaggtaatggtcatgattttaaaacttactagataggcacttttgcccagtcgtattggtctgaaagccacatcatatgtcaagaaaactctttgaatctccaagaatgtttcttcatctagccattgttatactgtacatattttttaataaattttttatcccaattatggaattttttttttcaatttaaaaataaatagccaatggaaaatgtgatgcagtactgcctatgtattctaactcataaatagaattttgatacattattttaaaaaactgtgctacaattacaagactggattttagtcctagctctaccattaaccagaaattgttcagagtactttaccttttctttccacctgaattctttcattctataattcatttccttcagctgtcaaatgaagaaaggaatgttcttcctatttcacatcaggaagcccagactgggagacaaataagaaaacagtatgaagttgttaaaatgttatagaaaaatggagacatatggatatgtatacaaatagtgataaatccatttatatatatatatatgtccatgagtgtacacacacacatcacacatacatacacatggataaggtggcatttatttaggaagattggctagaataacttattagaaaagcacaagtgtggaaattacgaggtgacaggaagaccacctccagtgacaccatggcacaattaggcaccagtggtacaattaggaccacttctatcagtgcatgtgagttgcggataccaaacattaaatcagtcgtaacaaagccattgtcaagtctaggagatcagaaaaatattccacttctctaagccttatcaaataatttgagtcaaattttagaattccaattttaggttcttgttccatgctgtaggtccatactgatgtttgttcttggctctgttccatctcacagctgctgatggcccaggagatcgtttcatcattggggaatcccaagctggtgaacaggtgagattgataggcctgaaaggcactgaagatttcagcttcatggactttgggcatctaattctaaatttctcctatcagtttagtggaaattagagagagattagtcagaagattatcaaagggatgaaagtatagttcccaggagaaccaaaagaattatttcttaattgaaagtatctacatctattaatatatgtcatagtattattagtatgtctcacagacatgccttacaagcattttccagacctgtgattgggtgattctttttttcctgaaaaaaaaaatgttctgaatagaacaatttctaggtagtcttctcagacttttccccaacttgtgttacaaatggggaaacttagaagtagattatttaaactttttagctaattatttaatttaatttttctcacttgggatctagccagggaacaggtttacatatatttttattaagaaatgaagcaataataggccacattggaaatacaagtccatttgacactttgagaccagtaattggccacttaattgaaaaatcagttaaagtgggaaattattttatatatttaaaataaatataaatttaacttaaatatttattagtcaataatttgatgaagaaccaaggtcttccttttaaataagtatgctgttttaatttctatcaggtctttcttacgtaaaccacacaaaaggcaatgtctctgatttccattttgatttcttcaaagtagaaaaaaactgaaggatacttgcaatacatagaagagcagaatccttttagggttttattatattttacactcttttagtttcctcactcacacctaattttacagcatttctttttagcagcatttttaatggaggtttccaaaaggttttacttaatttttataggaaaaaaataacatatatcattggtttatgtattatttatttatttatttatttatttatttatttatttttgaaacgtagtcttgctctgttgcccaggctggagtgcagtggcgcgatctcggctcactgcaagctccgcctcccgggctcacgccattctcctgcctcagcctccccagcagctgggactacaggcacccgccaccacgcccgcctaatttttttgtatttttagtagagaggggatttcaccatgttagccaggatggtctcgatctcctgacctcgtgatccgcccgcctcggccttccaaagtgctgggattacaagcgtgagccaccgcgcccggcctggccattgttatgtttaagaggaaatagcatctgtcaatccggtgagttacgaaggttgatcaacagagctcctaccttattaaatggaactagaaggaaaccaaagaacttttttcctttccctgctgcttcccttcaaagtttcctcttcctgagatggaatacccaactgctactaccaagcaatatataaaaataaaagtggcagcgggcgtggtggctcatgcctgtaatcccagcactttgggaggccgcggcgggcagataacctgagttcgggagtttaagaccagtgtaaccaacatggagaaagcccatctctactgaaaatacaaaatgagccaggcgtggtggcacatggctgtaatcccagctactctggaggctgaggcaggagaatcgcttgaacctgggaggcagaggttgcagtgagccgaaatctcaccactgcactccagcctgggcaacaagagcaaaactccgtctcaaaaaaataaaaataaaaataaataaaagtggcaagaaataaataaataataatttttaaaatgaaggcagcagtttggcaaacgctatgttccatgcctttcttccttggcttagcatggactaacactagaaacgagttgagatatataggagaaggatgatgccaatggtgttgacactagcttcttcattttagcatccaaaaattgaggagattcgcatgcaactctctgaagctaagttggcactatagtgatacatattctcatccatactgcaccaagctggatttcattaccatgaccatttttctgacaaaaagaacagctaggcttgattcttttttataaatgacttgtcttgtttgtttgtttgtttgggtttttttgaggggagggaggttgttcttggttttgggtttctgggttttttcttgagacagagtcttgctctgttgcccagcatgatctcagctcactgcaaccttcaccccagtatggactctgtgtgggggctccaaccacgctgggttctctattctgatccattggtcaatgtatctgttttgctgtccaaaccatgctatttcagttactatagctttgtagtatattttgatttctgacagtgggaagcctccagttttcttctttttattcaggatagctttggctatttggagtctcttgtggtttcatacaaattgtaggattttctatttctgtgaagattgtcattggtatttttataggaattgcaatgaatctgtagatcgcttttttcgtagtatggtcattttcacagtattaattcttccaacccaacgacatgggatgctgtttctttctcttttttttttttttttttttttttttgtggcctcttcagtctttttcatcagtattttatagttttccttatacagattttttacctctttggctaaatttattcctaaattttttttgtagttattatacatgggattgctttctcattttctttctctgctagtttgttcttggtgtgtagaaatgctattcatttttgtgtgttgattatgtatcctgcagctgtactatatttatcagttgtaagagtttttggtggagcttttagggttttctatatataagatcatgttatctgcaaacagggacaatctgacttcctcttttcccctttggataccctttatttctttctcttgcctaattgttctggctgggacttccagtactaggttgaataaaagtgttgaaagtgggcatccttgtcttggtccagatctcagaggaaaagctttcaactcttccacattcagtatgatgttggctgtgggtttgtcatctagggccttcactgtgtacactcattctttctatacctaagttgttgagagttttaaccatgaaggattgttgaattttatcagatgttttcctaagtctgttgagatgatcatatggtttttgtccttcattctgttggtgtgatgtatcacatttattgatgggcatatgttgagccacccttgcatccccacagtaaatcccacttgatcatggtaaatgatctttttaacgtgctgctggattcagttgcaagtgttttattaagcatttttgcaccaaggatattggcctatagttttccttttttgtgttgtatccttttatggtttgagtagcagaataatgctgacctcatagattgagtttggaagaattccttcctcttcagttttccagaagagtttgagaagaattagtatgagttcttctttaaatgtttggtaggattaagcagtgaagtcatcagatcttgggcttttcttcagtgggagactttattacagattcagtctcattactcatgattgatctgttcaggttttctattctttttggctcaagcttggtagattgtatgtattgaggaatttactcacttctgctaggttttctaattttttggcatgtagttcttcatagtagtctctaatgaccctttgtatttctgtagtatcagttgtaatgcctccttttccatttctgattttgcttatttgggtctttttttattagtctagctaatgctttgtcaattttgtttatatttgcataaagtcaactttaatttcattcatcttttgtggttttttagtctcaatttcatttgtttctcttatctgtattctttctttccttcttctgattttggatctggtttgttcttgcttttctaatcccttgagatatatcactatgttgtttcattgaaatctttctactgttttgatgtaggtgtttattgctataaacttccctcttaatgctgtttttgctgtatcccataggtttttgtctgctgtgtttctattttcatttgttttgggaaatctatttatctcttaatatatttattgatccattggttgctcgggagcatattttgtaatttctacatgtttgtacaattttgaatgttcctcttgtattgatttatagtttcagtccattgtggttggaaaaaaattcgatataattttagttcttttaaatttgttgagacttcttttgtggcctaatatggtctatctggagaatgttccatgtgcaagtgaaaaaaaaatgtgtattttatagctcttggatgaaatgtactttaaatatctgttaggtccatttgatctaaaatgcagtttaaatccagcgttcctatgttgattttctatctatatgacttgtccaatgctgagagtagggtgtcaaactccccaaatattattgtattggaatctgtctctccttttagataaataatacctgctttatagtgggtgatcccatgttcaatgcatatatgtttgcgattattgtatccttgtgataaattgatccctttataattatagaatgacctctcatatttctttttacagtttctgacttaaagtctattttatctggtataaatgtggctacttttacctgattttggtttccatttgcatcaaatatcttgattcatttcttcactttcagtctatatctgtataggtgaagtgagtctcatgtaggcagcaaatagttgggttctttttttttaaatccattcagcttgtctgtatcttttaactacggaatttaatctatttacatttaaggttattactgatagatgaggactcctgtcatttcattgtttcctggttttgcttaccccttgctccttctcttattgtttatcattgcagttgggtggttttctacattgatactgttttattcttttctctttctcctttattaatctggtctaccagtgagttttatgcttgtgtgtgtttttatgatagtgattattgtcttttttgcttccagatatatgactcccttgagaatttatggtaaggccagtgtagtagtaatgaattctctccatttttgcttgtctgggaaagactatttctccctcatttccaaaggatagctttgctgcatatagtattcatagttagaaatttttttatttcagcactttgaagatgttatctcctttcttcctgtcctgtaaggtttctgcagagaaatctactgttagtctaatgtggatttcattatatatgacttgatttggagacctttggaattcctggacctggatatccatacctttccccagacttgggaagttttcagctattattttattaaataagtttcttatgccttttcctttctttttttctgaaactccaataatatgaatatttgttcttgtatggtgtcccataagtcttacaagctttcttcactctttttcattcttctgtttctctctgtctctctctcttgctgggtatttcaaacaacctatcttccagttcaaagattctttcttctgctttatcaagactgctattgaagctctctattgtaattttttatttcattttttgaattattcagctgtaggatttctgtttggttcttttttatgatttctctatctttgttgaatttatcattcttatgaattgttttgctgattttgttgaattatcgctaggttttgtttttgtttttgtttttgttttatctaattgagtttccttaagatcattattttgcaatttcttttccaggagttcattgatttccttttcattggagtctgttactagagatgtattcctttagtggtgtcatatttccttgcttttttgtgtttcttgtgtccccatgttgatctgtgtgcctagtggaacttttgcttctttcagactttctgggtggttttgtagagacgcctgtagttgggctttagtgtgttggttgcaaagggtatggtgactttctggacaggtgcaatggtgtagtctccttgcagctttttcagttgcattcaatgtcagtaataactgtgagtacctcagtggcctaatccatagaagtttgtgtcagtggtagtagtggcataggctgttaatatccttggtgtcaagggcttttagagtcctcctcttcttgttttccacacaatagggagaatcagctgaagggatccctcttggtgttaggtctgacatgccctccaagcagctacagtggcactgggctcaaaatatggtgcttggagtgactgtggagccaggatccaaggctcagggtcttgtgaatccattgtggcacctggttcttggggttcaggttcactctctgtggcagagttgggtgtaggttatccaaagaaccaaggtttatgactgaggcaccccctagcagcttggacccaggtgccctggttgtacctgtgattttatacctcatgggtagggtgtagtactgaccaaactccaaagaaaaaggttttggccaggggagcagggtatggccgcagctcaggaaccagagccagtagggctcagcagcagctcgggtcacagtggataaggtactgtgtagtagtgaccctagacccctggatggtggggctacgcaggtcctcacttcagactctgaggccaggtgcagaagcagcagataccttagaatggcagagcgcagctgtggtttgatccccgggggggccaaggatcaacacagaaatgactcaactccccagagaggggggtatctcagcagctcagactctaaggggctatagtctagctccagagaagcagggtactagagttatttggcctgtaggtcaggatatcttggctcaatcagcactctgtttccctaggacatgagtgactacatcagctcagcctgggatgcgtaggtgctcagcttggcaaagtgtgtgcaacatactttctaagccttgccataacagagcaatatgtctggaaaaaggatgattaaagaagattagaaactatctccaatgtctggatggagttaagggaaaccaataaaggaatctgcagcacccaggagctagcaacagtgagatttccttaccacatcttagtctgaaggagcaaagaaagacaatggtacctgaacctgggaagattcatatctgtgggagaggactgcccaacagcagctcttgctctcagtaggagagatgccctaaccatcaccaaactgcagcccaggaggaaaagagcaaggggaatgaaaactctacttttctgtctctctcctaccctctacatctcttactgacccctccctttggctgagtctcaccagacgccaaagtggtgggaaactggttaaaatagtccatagaggtcagcttctggaccacagcacagagtagagaatgatgatgtgatctggagaggcaaacagaaaatgaaacaaatctttgtctttgtaaggcttatattctgtaatatataatgcacttaacattgtacctagcatagattgtgggttcaataaatattagttattggtagtattgcttacagtaataatattatggagagaagatttttaagacttttgtaataaatttcctgttttactttgattgtactttcagtagtaaggtatttttttttcttaaccattccctaaggggtgtgtgtgtgtgtgtgtgtgtgtgtgtgtgtgtgtgtgtggtttattttactttgtcttattttggtggttaaaataacaacaatgacaaaacatacacacacataacattaaatataccatcttgacagtttttaagcttatagttcagtagtggtaaatatattcacattgtagggacttaagattttaaatagagtcatgagttacttaatgaagatatattctgagaaatatgttgttgggcaattttcttgttgtccgaccatcatagagtgtacttacacaaacctgcatgagtagcccactacacacctagcctacatggtgtgacctgtagctccgaggctacaaacctgcacagcatattacagtattactgaatacgtaagcaattataatggtatttgtttatcaaaacaaaaagtacagtagaaaatatggtaatcttataggaccaccatcatatatgcagtccaacattgagcaaactatccttatgcagcacgtgactatacttatgaggcagacatctttagaaaggaatcttttggcaggggggattaatattgtctcaggattttttcttagggagaatttgaagcattcattttccaaactccagtctaaatcattgcccctgacaagtgactttcagatcacttctctatcagatcaaatctatcagatgaatcttacagaaaaatgcttttcctcatgttgtaagaagttagcagggaaggttctgtctcttataccatcaatatgagagcacaaacaatgaaaatcttgtttttcattttcaaaagtaatgtttaacctaggtcattacagacactggaatcatttttaaatgatttaattatatttgctcaacctctattattaattgataggtgagctaatgtgttttagaatattttcaaaggcaataattaaaatatttctggcttgcctttatttaaccaaaaagtttagttaataaagtactgcatttctcaaacattagaacttcaataagttatgaagatttttttttgtaattgttattcacaatgtatgtcctagcaatttttttacttacagactctcaaatcactttacatatattaggaaaatgtacattatttgagaggcaaaagtggcaaatgtaaatggcagttcttcaaaagtaaagcagagcaccaagacaccgaatagtcattaccttaaagtacacataaaatcagcttaaatgaacctaaagcccctttagtgtgagtgcacctgtttgtggatagcttttattacactggcccaaaatgaataagactgtaagactttcttttatggtttattttttaatattaaaaaaattaacatcctctgcagacttttcctttgcagcagcaaagtacatcaactgtctttttcatctttatttccagccaactcagacagtaatgccaggacaagtcatgcgggttacaacaggtgctccaataccctgcggtgctgatgcagtagtacaagtggaagataccgaacttatcagggaatcagatgatgtacgtcatcaccaagtcttactgtgctgttgttcctatggcagtattatgtcacaaccattttctgcagtgtttgtgagattaacccagttttttgggttgtttagttttgttttgtttttgcttatggtgggatcttatattgtagtatatgagtctccagtaaataagaaatttccttaatcttgaaaatctgttgttacaggaggggtttctatgatcattgctgttatagcagaatttgaatcatatttgacccaagcagtttcacatgcaaacaacgaaagaaagtacctcaagaaagaaatgcagagatattaatggttgacataccttccagagcagagatattaatggttgacataccttccagctgagaaatttgccattgagactagcttctgataaaatgtcaaggagttcatgaaatcagaatttactagagaagaatttaacaaagagcacttgggcaagttcttgaatattacactaagccaagcatttgaaccaaatgaccctttcacctctggttttctgtaagtctggaaaaagctgtgccaccaaatgacagcctggaaatattaagtgtatgtcagttctccctccattgcctcaagtaaaagatgctggaatctttttggacctaagcaagcctttatctcactgaaaatagtggcaggttattgaaaccagagtataagccagtaataaaagtagaatagattcaactgaggttttaataatcagctctcttacttgttttatgaagaaagtaaagatatattttaaagctgaggtgaaaaataaacatatattctcccaagccgagtagatagtaaaattggccatgccaagagacagacactttccctgatctggagattttctttttaatcacctttccatatgtaaggcttataaaattcaacccttggcaaacagatcacattgcctgctgttaaaactgcctaagcagatttattggcatcagggaagccagcaaagcactgaattccagaacacatacatccacagactctgccagatgacaagacacagttccaatgtcacaatattattcacagcccataaatgtaaaattgattactgcaattaatggacagaaatctactaccaggcaaactataagtcctttactgaaatttctgcaagtatttggtaaccttggcatggtattgaacccatgattcatgggaaaagaaggaagatattacctccacacacgttcactttattagggtagccacctacatatgtatataaaaatatataaacaaattctatataatgtattagttcaaatattaaatcttataaacaagatttaatatttgaattggtacattttttaaaagcataaaaattggagaaaaaaattttttatttattggcaccaaaccttctaatttttcaggaacctgtgttagaaattcagtgttttcaaagggtgtagcaaatagttttctttttgtctatatttgtatatatcctgggcctatctgatggtaaaagtatcggagtaactaaattctactgctcagaaattctgtttgaaattacatgaccggctgttattatagggcactgaagaacttgaagtgcgaattctggtgcaagctcggccaggccaagatatcaggtaacttcaaaacacatagaatatatagcctacttttgtttctacatgatcatttactcaggaaaccctggctactataaatctgcagccatgtcagttagccattaattttcagggctttaacaaaaagcaaaatgaatgttatgaattctgtatcacatatctgccctgcctactttttaatgaagatggtaaaggcgagttagtcaaaagcaagatgagaaagaggtaaagtcatgagcctacatattctacagttaattctacttctagataatccagaattacccaatcccatccctaaataatctggaatttggtatcaactcagataataccagaattgggtatttacacaattaactaatagcatatgctctagtgactaccaataataatggaataatctgttccttgttatatacaaagatgaggctatttgctatgataaatagtgcatataccttaaattatttttcttaaaatggaatatgtttaccctgattccattaatactaatttgctgaacatccctttgtaacgaagctacacttctcccatccctatggcagcacaccaaggttaatgtacctcagtagccacagatcaggaccaacctaagtggtccatatggaaattacctctatgactgtagcctcattagcattattctccttgacaaagctagccagctgtggacctcttatcattaatgccgctagatattgccatacaaattcttgccttatcaaagaaagtttacaattggtatttttactataatgtaacataaaacaatttgtaaagtaattttattcacaggtactcatgaaaaaaaatttcaaatatgaagtaacatgtttttctttagcagtaatacattcaaatcctatttctgttttctgttgtgtgatttaacttttaaaattaaaaaagcataggatttttagaatcccttcaattcattgttttcctactactttatttctagacttttttgtcttcttgaatgtccttttttgacactaaagtttccctctgagttgagaaaatgttgttctctaatcacactgcttatggttctgctttgactttcagacccatcggccatgacattaaaagaggggaatgtgttttggccaaaggaacccacatgggcccctcagagattggtcttctggcaactgtaggtgtcacagaggttgaagttaataagtttccagtggttgcagtcatgtcaacagggaatgaggtattaaaaataaaaatggagggagtggggagagggcccataagataaaggtatttctgacatatgttctgtgttgtaaatagaatgttgtagattatagatcataccagtggatccacattcttataacagggaaacaataaattggctttaggatagtttcaagttcagaatatgagaacaaagaagaactagtaaaaattatgtattatgaaatgttctcttctattagaatgaaatattataaccaatggcctttccacaaagtcagtacacataagcaaaaaactttagctgctagctatagatattaaactatacaaactcagtactgtttctgtttagacaatgaattgtgcccatcctgctgctgaaatgatgagctacttctgtgtgggaagtatcaatgaatcaggacatcatggctagcacttcttgtgaaaagttccatttgatctttaatcactaagagggatttgataatcaggttttttttttcctctctctctccctaaagatagcatctctagtggcatgatatttagaatgggtcaaaatgtcttttcattcctgatttagaaaagagaatttagtccatctctttctgagaactcttgaaaaacttcctattgcttgttttgcttaggttgtgcaaaacttcagtcagaagctccaaggtcaaatggagaatactaaaaagtgaatctgctggaaactcaaaaccttataaaagaatcagaaactattgagatttttaaaagtattaataattcctttgaccttactattaaagaaaagattagcgggattttttaaaaatctctttgttctgaaaataaacccatcattatttttaatttcttgaagtcttggaaatgaaaattttcagaggtctttttatgacattatagtccttttggttaaagcaaaagaatagactgttttattttgcaaatagatagctaaatcaacattccagatgtgcttacttcccagtatatatgcactagtcatttccaaaaactattgattgacaaaaaacattcttttcaatttgatctacatagtaatgattttaatatccttagaaccaaataacactatatatagcatcagaaataaatttttgttaaactggttgactcagtgaactattcttttttatgatatacttacatgctttgtgcaacaagtaagttcatggagtttgagaaagctaaacagtagcacactcatggaccaggcatggtggcttattcctgtaatcccagcatttagggaggctgaagcagggggatcaattgaggctaggagttcaaaaccagcctgggcaacatagcgggaccctgcctctactaaaaaattaaaaatagctatgcatggtagcacatgcctatagtcctagctactgaggaggctgaggtgggaggatcacttgagctcaagaattcaaggctgcagtgagctatgatggcactactgcactttagcctgggtgacagagtgagaccctatctcacaataaagtaaaataagaattaacacactcataataactatttagttaataggaaactctgtttaagcgatattgcttatatttctctctcatgcttttgtaggtctggactcatcctctcaattatccacagagtatattgttagtgttttgtttaagctaccttttacactcaattaaaactatttactggaagtaggctaaggtaatggggtgagaatagagatggtattatatcatgaaatctagggaagagtttgtagtcttagttccctgcccccacagagcttattactcttgaagaagctttgactaattctacatgacttattcccctactttaacagacctgctatactaaactataccacagttttccaagagaataatgcttctaaattatattatctctggttccatatagctcaacattcctccctttctcttattcaaagttagtttttattatgactctatgatcatatagtttagttttgttcagcagataattgggtacctctgtgccaggcactttactggaaattggtgataaaaaaaaaagagataaataaagcatattatctctccagaaggcttgaaattctcagatacctagaaaacaatagcaaaaaaaaaattacctattttcagagagggcaaaagaaattgcacttaatgtagcaaggccataatttacccagtcacagtacaaactttccttaagtattggttttagtttcctttgatacatatggtttcaggccgggcatggttgctcacacctgtaatcccagcactttgggaggccaaggcgggaggatcgcttgaggtcaggagttcgagaccagactgaccaacatggtgaaaccctgtctgtactaaaaatacaaaaaaattagctgggtgtgatggcacatgcctgtagtcacaactacttgggaggctgaggcagaagaattgcttgaacccgggaggcggaggttgcagtgagctgagatcgtgccacggcactccagcctgggtgagagagagagactccatctcaaaaaaaaaaaaaagatatatatggtttcacatatgtccacttcttgaatctcatatgacatattggtaagcaggacagttgccttggcaacccaaagagtgccgtacaagatgtctatgtatactctaaaacttgccccagtattttattactgtatgagcttgttaaggaccagcaaattatttcaaaattggggatatagagttatcaactatagctaacatggaatagctgatttctgtattcgttgatttcaacaaactgtgcatattaaaatttagatatgcaacctgtggtgattcatgtctgtaatcccagcactttgggaggccgagatgggtagatcacttgaggctaggagtttgagaccagcctgggcaacatggcaaaaccctgtctctacaaaaaatacaagccaggcatgatgctatgcccctgtagtgtctgctactcaggaggctgaggcagaggttacagtgcgcaatgaccattccactgtactacagcctgggaaacagagtgagacaaagaaagaaaagaaaaagaaagaaagaaaagaaaaagaaagaaagaaagaaaaagaaagaaagaaacagaaggaaaagaaaaaggggaaggggaagcaaaaagaaaagagagaaaagaaaagaaacaaggaaaggaggggagggcagggcaggactgcttaggagatgggtgcaccaaaatctcactaattaccactaaataaattattcatgtaaccagataccacctgttccccaaaaatctattgaaatgaaaaatgtttaaaaaatagaaaaagaaaactcattcataatccaaaaaagaaagaaagagtctcgccattttgcccagactggccttaaactcctaagctcaagtgatcctcccacctcagcttcccaagtagctgagactacaggcttatgctaccatagccacttcacaggacaggttttaagccaatcaaatctgtccagagtcatcttaatggaaatattatattaattattttctaatacaatttgtaaacctctgtatttctaaaccaaattcttaaagactccttaaattgtttaaaagatctaaatgtttctcttcccttcttatcttgtaacctagtaagccaggcaattagcttaacgatcagttaaacctttttttccccagagttgtgttaaaagctatttgcaacaggaacattcttcatgagagctcattgacttttctccctctttttgtgttagacctatgtatctgaactatctgggtgtatccataataacaagaattgagttttgatcaattaatagattaagttttctagaagacagagaaagaaagtgagatgattaccacaaatatgtaaagagttactgaccactataaaagtcaaatcaccttctctttgcaaagagtgggaaagccttaaatgcaagcaaacccatttcaatacatgagaaagaaaggaagtcattacaaccagttcaaatagtatcttgggcacttgataattccatcaagactataggattaattaagtctttaaaagtactttcaagtgaataattgtagtcatatcaaaagtacttcaaaatgaccactgcaattccaggttgtccttgatgaaattatgctttttagaaagataaatgtgtgaaagagaaaacagaagccagagttatgcctggagatagtgcaagtttattattaaatgaacccatgaattcattagctactggtcattcaaaagggaaaaatagcacttaaatattgtacctaaagtcctcaacagtaaaggttgaacccctggcagctaaccctgaaacctaacaagctagaatgggtagagaggaaatctctcccaaagccagtttctcatagacaaaactaagaaaagttcttataggcacacaacaatgtggccaactgacagataggatggccagtttcaaatctttactaagaaaaacaaaaattagtataaatccaatcagataaccaaacaattctggaaaccttataacaaaaacaatatcagctgtctttgggagttcagcaaaaaaacgatcagacctcaaaacaagggctggagttaatctaagcatcatagacaaggaatctgcccaagcaaaaaggcagaagagacctcactgaaatacagtataaccaataatataactggtggcaagagttcctgcctaagtcttggtaggattttcataataccaaaatcctaatacaaagaccaccagggaaacctgttgatcatacaaaatggttatattaaagtttctgagaaaaagaaaacatcaccttgacaatgttggggagggaaaaataatttttcctctacccttgtgagttcttacctgggacctctataaacgatagattaacaagaaaaaaagagaagttagttaacatgtatacctcgtgtatatatgggacatacccaagggaaaattagtaactcctaaagtgatggctgagaagtctggcttaaatagcatcttcagcaaagaacagtacattcttagagaagtgatgagacaaaggaccttgagtctctagggccggcaatttgtgggaaggcaaatatatgggaaactaatgatagattaaaggctagttaataaagtttgatatataaattcctctggcgccatctgcaggctgataagtgtccaaagatttatccctcgggccaggcgcggtggctcacgcctgtaattcaagcactttgggaagcctaggcgggtggatcacaaggtcaggaaattgagaccatcttggctaacacacggtgaaacccctactctactaaaaatacaaaaaaattagccgggtgtggtggcgagggcctgtaatcccagctactcgggaggctgaggcaggagaatggcgtgaacccgggaggcggagcttgcagtgagccgagatcgcatcactgcactcactacagccagggcgacagagcgagactccgtctcaaaaaaaaaaaaagattcatccctccaggggtcgcggggggagttacctttcttaatttatgtcctacttttaggcaaacaggagaaaagcagagagcgtttcttatatttttcttctcaagtgccttcggctaaaaaatatttgttatgctggcatattttggggtagtatattctgctacccttcaacagagtctcagtggtgtttcacaactgggaagtcataagatttttatgagggtatttataggattttgaggactagggttggccatgggatagttttaaggtagaagttattaagcaaagtccgagcagagattggtcggaatttgtaaaataggtgaattggtggatcacagtcagtcttatcttcagagcatatgaatccatgtggaactactgttaaaacaagttgtccatgatcttatcttaaagtatatggatctgaacaagcttgtgttaaaaacaatttatttcaagttacatgtcctggtttggtacagtttagctgttatgcaaataatggtatagttttgcaagttgatgtttctgttttatttctcagaaggaaatagtttgtaggcaaggcagccaattataaggctttcacagaaattcagacataatgtaatgaatgtctagaattgttttgggaggtagtaaaagagtgaatgaaaatgtagggtcaaggaagagatggattagaatattcttaatgattgaggcttttgggaagagtgggctacaaaggggaaaacaaagttaaatgtttaggccaggcgcagtggctcacgcctgtaatcccagcactttgggaggccgaggtgggcggatcacctgaggtcaggagtttgagaccagcctgaccaacagtagagaaacaccatctctactaaaaatacaaaattagccgggcgtggtggcgcatgcctgtaatcccagctactcgggaggctgaggcaggagactcgcttgaacccacgaggcagaggttgcagtgagccgagatcacgccattgcactccagcctgggcaacaagagcttgatgctgtctcaaaaacaaaaacaaacaacaacaaaaaagtttaatgtttaaaaagtgggaagatagtggccaggtatggtggctcacacctctaatccaagcactttgggaggctgaggcaggtgaatcacttggggtcaggagttcaagaccagcctggccaacatggcaaacccccgtctctactaaaaatgcaaacattagccaggcatggtagtgtgcgcctgtagtcccagataggaagctgtggtaggaagatcgcttgaacccagggggtggaggttgcagtgagctgagattgcgccactgcattccagcctgtgcaacagaataagactccatctcaaaaaaaaaaaaaaagaggtgggaagatagtggtaccattgataataccaaaaatgggaaattgaacttggtgacttgatatggagatgatgggttatgttttgttttacctcatatttttttcttttgaaactgtaataaatttcagacatcattcccaagatgactggaagtataacagaaaataagattcagttttaaaaggaaaaattgtgagtttattctagtatatttagccttatactcttccatttaattctgtattgttttatttgaaattatttaaaatacactgtaaatcccacaccctcatttaactagctattttttcgttatgtcagttttacagacaaataatgggttctccagtgatctctaattttccgttatttctggaactgtttgcagcaaaataacagagaggaacataaatagcaaagaaaacaccctgataacagaggaatcttacttagttcgtggtcaataccctgctttgaaaaaaatgatataatcacacatttttctttctaaagcaactagtttgattaatggagttaaagagctgcaagccttgccccttataaaattataatcactttaataactgtgttaattaagatcagaaaattaatctatgttagcattgcagtagcaattttccaagtactgccagggagtaagaatgaaagtgggttacaatgtcacatggcatctgattaagttaaattagtaagtattcgaagggaagactccctggtgacactgaataagatggtcacagttttcctgtagcctattgtaaggggacagttggttgcaaagctactacttttccaatataaagtcaaaaatctggccacatactatcactaatgagtctgaaggaagattaggacttgtggttattgtctgggagaattcatataataagctctggtgttggccatattagtagctaaaacatcttaaatgtgcaggcttgcctttaacctcctaaaataatagtccaggttttctcacttcaagtaagtacttctttttttactttataatttctgaaatcaaagcatatcttaaaactgatacataaattgttgtaagaatgtatctgtgtatgtgaaggaccccctactcttaggtattttataatctaatagtctatgttcacattataaactgatgtcatctgtactagcatctaggggtaacaatatgagaacaattgggaggaaagtaggtgatcctttgacgtcatatgtcataaagaaaggaaagagaatcacatttattgtacatttatctgcataaactgaatgttcattatctcactcctaacaattaccttgcaaggtagttattattactatattttataaatgagaaaattacgacaaagaattttgtcaacttgaatttgaaccctgttggaatccaaagctcttcctactctacaatctgactacctcattggaacatcctaaggtagaataagcttcgttaattttcttcgtagacatagtagatattaaatctctaaagattaattcagttcagaataatggaattgtgcatacatgtagctaagtattacttaagtttgctagtatcagagacaaaacatctgtcttcctctccttcacataagcttagcttctttgatactgttgaccccacttcagaaaagagacaaaaaagtttgaaagaaaagataaactattattctgttcagacttaaggatatcatgtcacacaatctatacctcaaatattcccaatggaagacaaattggaaaataatattgggagaaaaaaagataattgttttatttagtttggccagtatctccagagcattattatcaaattggagcccaacctggtgggatattttgcatgcagttcaatcgccagtgaaatttcagagtgttttttgacttccataggaacattttctcatcctcctatactttcaatatttatttaaagatcctttgggcattcaccttcaaaatgccagataccattgtaggtgctagatatgctaaactcagtttagtagatttttttttcattagaaatatgcaacattaacctaatagaataatttgtggtggttttttggctttgtagctgctaaatcctgaagatgacctcttaccagggaagattcgagacagcaatcgttcaactcttctagcaacaattcaggaacatggttaccccacgatcaacttgggtattgtaggagacaagtaagtatttgatgtcattctgaaaagtttgtattgtacaaatacgagtttttggaatactcattaggtggagttgctgctaaagagacagaaatttaatgtcataattttcacttatctcattcttcagaagccaaagaatattgaggtatctatgtcctttagagataaagatttcttggaatgtctctgaaaacaagagaaatactttactttcctgtagtatgttaggtttcaaaggatgtttttgtaatagttttggttttatcccaatggagctaacagtgatggcattattctgatgcacatttttacttctttcaagaaagacaggaaaagcataggtaagaagagaaagagagattgtcaaaagtagcactacctaattctttgaaatttaagtacaatttttttctaggacttctatattgatttttgtgtctttatgtaacctgtttctccaggctttacctacttgaaagtacaaagggaagcacaatgactataattactcaatttttaagagcctattacccccatctactgaattaactcagccctctgctaagttttctaagtatttctgtgaatctccagtgctgtctcatgtgtgatcaaaagcaagtctacactttctaaacatcctagtatcatgcaacactgctgcctggctgtctttcaaaagtcaccctttccatttcactagagctacacctgcttttagtaatactcaaatatcaacccaatggagacaaggctcagagacagatctgagtgataaatactcatgatgtatctatcacccataatcccctttctctcttatcactacctcatcactgtgtagacctcattaagcatggatccttcttcccttatgttgagtactttcccaaaactcagatgtgcttttgaagaggttctgacctaccattcacaaggtaggatctgacaaggcatgctgtgaactttatcttaggctcacactggacatagtctaacctaagcttgtccaggccaggcacagtggctcacgcctgtaatcccagcactttggaaggccaaggcgggtggatcacttgaggccaggagttggagaccagtctgactaacatggagaaaccccatctctactacaaaatagaaaaattgcctaggtgtggtggtacacatctgtaatcccagctactcgggaggctgaggcatgagaatcatttgagcctggggggcggaggttgaagtgagctgagatcgtaacactgcaccccagcctgggaaacagagtgagactctgtctcaaaaaataaataagtaaacaaattaagcttctccaacccgtggcccatggaccacgtacaacccaggacagctttgaatgtagcccaacacaaattcataaactttcttaaaacattatgagatttttttgcgatttttttttttagctcattagctatcattaatgtattttatgtgtggcccaagacaattcttcttctgatgtggcccaggaaagccaaaagattgaacacccctggtctaaaccttggacacaagcatcttgccagtaacctgaaaggtagtagcttttatgtcatctaaccttttgaagttctcttctttcctcctgatttttttttctttctctgaggacactggagtggaagctggtgtattttcaaatgtcattctttttaaaatcttcaccatttgtatttgcatggatgtttagctctaaagaagtttggccaggagtggtggctcacacctgtaatcccagcactttgggaggccaaggcaggtggatcacctgaggtcaggagtttgagaccagcctggccaacatggtgaaaccctgtctctactaaaaatatgaaaattagctgggggtagtggtgcgcacctgtaatcccagctactcgggaggctaacacaggagaatcacttgaacccgggaggtggaggttgcagtgagctgagactgcaccattgcactccagcctgggcaacaaagcgagactccagggcccctcgtcctaagaagggaaagtaaagccagtgtacaggaaggaaaggggggaaaaagccagttatttgaatttgggccttagcagtaacctatcctttaagatacaagtacttaaaaactatcctatccagatacagcttttccaaagaccaaaatcaacttctgagaagagaagtgataaatccaagagtttgaaaacacaaagataaggcaagcaggcttgaaacttcatggaacaaacaccagattcttagggttatttccctcctaccaatggctctggccctacctctaagtgcgttaatgagctctaagaaatagtataaggaaaaagggagcttttaaattgtttttaccctaatttgttctggactataattctgcccattctccctcttactgttatacttttttttttaaagaggttacttaatatactgtatatactgccattatcttgaagtactctaaaggccaaaacatcattgaaaggccaacatgttggtatgctgatatttttctgggatccacactgttaatttgtggtggacatttcctaataatggtgatattgcatttaactccaaaatatactttgaaaacagtataaagaacaacaaaactataaacaggttaaggcaattcagtgaatgtacaaatctctagtgtatacccttttcttgaatagtaataccttatatcaaactgagaacaatttaaaaaaaaaagaaattgatgcaaatctaggctttcttagtcttagagtgctatattgaaggggtccagagtgaatggtgtagaatgcagaggtggaatgtgggaggaaagaatttataattgttctaatggaaatctgtgctgggagtttagcaaagaaaacaaggtatttaatctacagcctattgatattctgtgaaggctaccctccttcattcttcttcatcctattcagccatttgctaaggaaagcaaatattgtcacacagaagcatctgggtaaagctctccagggaaacaagcagagtcatgggagaaactgtaccctaggtttaaagcagggagagaaatagctcaagaatgtcaataagggcgaggtgcagtggctcacgcctataatcccagcactttgggaggccaaggcgggcggatcacctgagatcaagagctggagaccagcctgaccaacgtggcgaacccccgtctgtactaaaaatacaaaaattagctaggcatggtggtgcatgcctataatcccagctacttgggaggctgaggcaggggaatcgcttgaatgtgggaggtgggggttgcagtgagccaacatcgtgccactgcactccagcctgggtgacagagcgagactctgtctcaaaaaaaaaaaaaaagtcagtaagcacagaaccttactcaactatgacagataagggtagagagtgacagctctatttgtatcattaaaaaaggtttgagtctggtttttaaattctatatgattctatttctcagctcttattcttatcacctgccataattttgacaatcaaagtaaaaatagaagaataagactttgtagctctttgaagtgagttggactaaatggcctttgcttactataccttttattttaaaaggttaatttaatagtactatgaagattactggagggatgcttcaaatacctgagaattaacaactgtatttgaaaatcattcatttgtaaacattatatatatattaaaatacatttcttgttttctcacactgtttggaacacagtactgttggagttcctatagtctttttctttaaagagacacattttgaaacccagagatattaagtaacttgcccagcattatactactagttagtggcagagataaaaatggaatctaaatttcctgagattgacaatccataattctctactatcattataaagacaagatattgtatacctgtgtactactgtgggctggattggtcagacagagttttataaacctctagtttcaagctagaacttaaaagaatgagtaggatttagataggaaaagagagtgtgttaatccaagtaggaaactgaatgcacaaagtagagaagtagaaacaaatagtgtctagagaattagaaatgaacaagagattcaggtagaaggataagacaggtaaattgagtagaaatttgaaccagattttgaaaggatgtggagaaataggaacacttttacactgttggtgggactgtaaactagttcaaccattgtggaagtcagtgtggcaattcctcagggatctagaactagaaataccatttgacccagccatcccattactgggtgtatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcctgtcctttgtagggacatggatgaaattggaaatgatcattctcagtaaactatcgcaaggacaaaaaaccaaacaccgcatgttctcactcataggtgggaattgaacaatgagatcacatggacacaggaaggggaatatcacactctggggactgttgtggggtggggggaggggggaagggggagggatagcatcgggagatatacctaatgctagaagacgagttagtgggtgcagcgcaccagcatggcacatgtatacatatgtaactaacctgcacaatgtgcacatgtaccctaaaacttaaagtataataaaaaaaaaaaaatggctttgcaatttaggctgccaaactacccaattcagttaaatttgaagtttgggtattttttggtttgtttgggtttttgtttttgtttttgttttgccgaattgacataaaaaacaattattttaaaaagatcaattgacctagatttatcatataagctaatgatggagactggaaataaggagaacaatacaatttgtttactcattgtttaatcagtcaccaggaagtattgattgtgtacctgtgagtcgtctggagatcttattgaaaatgttgattatactttaacaaatctggggtgggctgagattttgcatctctgacaagctccaaaattataccaaactgcaggtctgtggaacacaggaagtatcaagaatatagtaagatcagtcatgcgtctgctatgaattttaagccaaaggctatggaagatacaaaattgaaacagatattgatcttacttttgaagaatcacaaattccaagcagtaaaaatattttagaaggttccagaacttaaactcaaatttggaactataagaagaaagagattaaataaagagaaatattgaagtctattatgtagaagagagcagtgtcactgttgaattatctttgtctggattacaaagcctcaaaatggtatgtgtatgtaaacacaaaatgcctggaaaagcaagctgttaggcctctttaccacaattttatattcctgtgtagcaacatactatttccatgtcttcattctccactcaaaatctattatttcttggcttttatagctctttttgctatgctcattcccctaaatataggtctccccgtggcttacccttggctttctgtccttttcattctgtatgctaatgactgactaccaaatcttatatccccagcccaaatatgaaactagtaaagcctagatattctgaattggcacaaatttatgtgagtttatatacttttaagcacaaccctatttctacttttttttttttttgagacggagtctcgctctgtcgcccaggctggggtgcagtggcgtgatctcggctcactgcaacatctgcctcccgggttcaagtgattctcctgtctcagcctcccgagtagctgagacgacagacacccaccaccgtgcccggctgctgtttctacttttttcccaaaatacattttatttgaaaaaagcaagttgcagaataacatgtttaattttatctcacattgaatagcaactgaacaaacatatatttataaatatggtatatgcatgggaaggtatttatatgtagaaataccctatacacccaagtgttatttctagtagtaagagtttgcatatggggtagaagttagagaattaaaagtgatggtaagggccagccactgtggctcgtgcctctaatcccagcactttgggaggccaaggcaggtggatcacaaggtcaggagttcaagatcagcctggccagtatggtgaaacgctgtctctactaaaaatacaaaaattagccgggcgtggcggtgggcgcttctaattttttttttttttttgagacggagtttcgctgttgttgcccacactggagtgcaatggtgcgatctcagctcactgaaacttctacctcatgggttcaagcgattctcctgcctcagcctcccaagtagctgggattacaggcatgcaccaccacacccagctaatttcgtatttttagtaaagacagggtttctccatgtttgtcaggctggtctcaaactcctgacctcaggtgttccacctgccttggcctcccaaagtgctgggataaaaggtgtgagccatcgtgcccagccacttctactttttttttttaatatttctgaaatacttgaatatttttaccctgaggatatactgtatttcttttgtaataaaagaacctcctaaaaattccccttatgcattattaaaaatttggtggaccagtattgacaactgtaatcaaactttccaaaacggacaaaagaggcaagcagctcatctaaggaatctgaatctaagtaagagctattaatactattaggtgtgtaatgccataaacatagtgataagtaggcaaattaaaaagaagccaaagtcttgctgcattttaagtaaaattataatattttgtaatacaacaaaagtttaaatcaaaagattatagaaaacatacttaaatgcaaaatcttaatgtctatattgactttgaattttatttctcatactattttgcaattgctcaaataataagacttgaaaatttagccatagtatatatttgtagaacttgacagataactaatgtaatagaaaccttagcctacctacattttgttttctccaagcataaaaagtatttcatagctatgttttgttttccagaacccatggtgataaactgttcatattagatattttcccccaatagatgataggttggcagcatcattgactagaaagaaagaaagaaagagagaaagaaagagagagagagggagagggagggagggaggaaggaaggaagggagagggagggaggaaggaaggaaggaaggcggagggagggaggaaggcaggaagaaagagaaagaaagaaagtctttaatgttacccttgacaaaatatcaactattttacctcatctagaattctacaaaataataatgtaatatattggctttgaattttcaacctctcattataaattctttttcttcattttcatgtcgttctttcttcttttgattgcacagtgcctttctattctttctgttcttttcactcaaatgcattctttatatatttacatattttctactttttaaattttagatgcaggggctaatgtgcaggtttgttacatgggtattttgggtgatgctgaggttttgagaaccaatgatcacgtcacccaggtagtgaggatagtacccaatagttaggttttaggccccttacccctctccctccttccctcctctagtagttcccagtgtctattgttgccatcattatgttcatgagtacccagtgtttagctcccacttacaagtaagaacatgcagtatttggttttctgttcctgcattaattcagttaggataatggcctccagctgcatccatgtagctgcaaaggacatgatttcattcttttctatagctgtgtactattccatgatgtatatgcaccactttttttttatccagtccaccattgaagagcattctatgtctctgctattgtgaataatgctgcaatgaacttaagagtgcatgtgtctttttggtaggatgatttgttttcttctggatatatacccagtgatgagattgctgggttgaatggtagttctcagttctttgagaaatctccaaactgctttccacagtggctgaaccaatctacactcccaccaacggtgtgtaaatgttctcttttctctgcagcctcaccaagatctattatttactttttagtaatagccatttggactggtgtgagatggtctctcattgtggttttgatttgtatttctctgtgattagggatatgttaaatgatcatatccctaaacatatgttcatatgtttgttggctgcttgtatgtcttcttttgagaagtgtctgttcaggttttttgcccattttctaagggatctaccttaaatatggaacagcagatgtcctagttttcttttccccgaggctggttcaataacctattagcctcctttagtcctcctagacagtgtgagctactgtaggggaagagttgaagacaaagaaatgtagatgggtaaataagtactgaatgctatatgtgctagccaagcagttgtggccagaacttagtaagatattggtcatttgagcacatatatttttctctgttactgctttttttttttcttttttctcagtttcctaataaatttgctttgagaagttgttgtcttgtatggcttaaacagggtggaaaaaggatttgtgagtattgggccagggttgttttctttcccaccagataagctccatgaatactaggacaaagtgtatgttggtaaacactatatccacagcacttagtagggatacattaaacagccctgccatcttttcctataccattctctctttccatgaaacctagaaactttcaattatacaacagtccagaagaatcttacagggccccttcaaagtaagtccaaaagccttgaccataggagcaggccagaaagtatggtactgacagtagagttgcattcctgagacacatccccaaaaaatgtacagtgtaaagctttgtggctgggtggttcattttatatttctgaagaaaagcatcttgggagaaattccaaatagatttagcaggcttttaatttaaaaaattgaggagcagctctctcaggcttgaaaagatcttacaaatttacttcttgaatataacaagcggtaatcattatccaaatagaatccacttggggaaatttttttaaataaatttcagcattaattgagtttatataattcctcaaactgattttaagtattgaataaggattcaactttatgacagctcagcaatatagcttctgaactgccaacttggaccttctagcctttcaaggcctgaaggaagggctgggaaattcccatcattaagaagatttcccccttctggaaaattgccatcacagaagcctgccccactcaaatcctgggcttacttgactatgtcatagattgatgttttgtatttgaactgcctcctcttgctgctgcgaatttgtgaagctacctctttatattaaagcaagaagcagaaggacaaatactgagatagaaaattgggttcttaaaaacctggcacatttagcaggaattatcaagatagacttaacagcacagtgattatttgggcaaagccgagtgccttacaacttccaatttgtgaaccaaacacatcctaatttttcattgcttacccaatgttcttaaagtaggagttttctaatcatcaacgataatttagatctgaatttaattggttcttgtcatttttataaactatctgctctccttatggcatgaacctccttttctgctcaaaatgcaaagttttcatttttgagtcaacataatagatttattttcttctttttttttcttttactcctagcaagctgggatagatttattttctgatcatttttcagcagaggtttctcattttctattggttaacaaagaacattctttctaccttaacaaacgtgtttaatgacgagaggttctttccgatctcagtgatagactttttatgtagctgttagagttgccctcctttatctttaagcgttgctattgcagttgacatttctgtttcttctatgaataacctctaggtattactgtagctttagacattgttttcctaccccaaactcataaaaagtaatgtcttccagaaagcctgtcctaattatctccaactaattctaatcattctatcccatttaccctttttgtcatttctttatattatatataaatatatgatatatattttttcattttaattaatgtatttgaattcaacagatgatattaatgtcattgcttatttcactcatttttctaactttttttcactgatgagttttctgcactagcttataaacttaaaggcaagaaccatgctttcttctttctttacatgactccatggtcccagaacacccagtgagactggaaaagaatgaaatgatggctatatgtgtagtatgtagtttgattccatacgtgaagtagacacccagaaaagatttgtagttaatgaatttatctttgacctctgaagaaactatgatatgataatagatgtcctcagctattttttgttaccttggtatgattaactgccaacattctttaatccacacatcctagactttttctctgtgtcatcttcactcatcttaaaatgatgcagcttgcagttggtgtaacagatgaaacaggaaactaattagcagctgttgtccatctgtgtgtttatattaaatattttaaaatagaaatgtatttgcattctgaatactgtttctgaaattcataaatcctaaacttgggtaaatgctgtaaaattcaaaaccaagacagagcctttaccatttatcttcatgataaagcaaaaataattttatgccagaatcaggattatagtaatttgaggcagatgtaaattttaaaaagcaaaaaaagtcttaacttttttaagttgctttggaattgagcccccaaagcaatcaaattgaaatctgaaaagatacagtgttcaaaagatgtcataccctctgaatatattctttcttcacagaaactgatgagtacatacacttttgagaaagctgcattcattctctgacagatttattttgaaacatgctcctcctttctctttttctacctttctattaagtgcgtggttctttgacatgtgatcaacttagaactctacagagagtgctattaatattggtagccatcttccaagttgaagatgaatgtcatggctttaggaagaaaagataccgttattcatttcactcaagtcaaataggcaaatgtttcttatgttcaaaaatgaaagggagaagagtattatctacaagacaagtatcaaattgcatcagtcaggtcagattggtgtttccctctatgcttcagtttatatgtgaaaagaaaatagtcattgtgtttatgtaactttcagtatttccatagaatcacagtatcttattctgatgttagctagtccagactttcacccaagggggtgttaaggaaaatctgcaacaacttagctgttaggtttttgtttgaattcttttagtgagaaagatctctactgcctcatgaggtagcacattctattgttcgatggctgttaaagtaagtatgtttttccattacacagagccagtctttcttcctgtgtctttcatctgttagccctaattctgccctccaagcaatgccaaataagttggcttcctcttttacatgatatttgaatatacagttgtttcaccttaatcccttctcaaagtactgtttatgattatatgtttagcagtatcttttctttcatcccagacaatattattagcctatgatattataattgagtaactaaactatttactcccaaagctactgtggatagactgacttgaaatcaagtttcattcagcccatttactgagtgcctacaatgtgcaggaatttggtgggacaatcaggaagtctggatgaaatgagacgctgtcttgtgagagagttgtatactgctgcatcacctttacaaagtttccttttatcacaatttgttgtgtctctttattcttttttttaacatcaaatcccgttttgacattaatattactactcctgcttttttgcttatttacatttgcctggtgactttttgccctacttgttattttctttctttctttctttttccttctttctttctctttctctttcttttttaatttttcttttctttcttttttcttctttatctttcctttctctctctttctttctctctttttttctctttctttctttcttcttttttttttttttttttttttttttgacagagtcttactctgtcacccaggctggagtgcaatggcacaatctcagcttactgcaacctccatctcccaggttcaagtgatcctcctgcctcagtgtcctgagtaacgggcattacgggcacctgccaccacacccaactaatttttatatttttagtagagacagggtttcaccatgttggccaggctggtctcgaactcctgacctcaagtgatccacctgccttggcctcccaaagtgctgggattataggtgtgagacaccatgcccagcctagatttagctatattttttataaaggactgtgtgtgtgtgtttcactactgttttctctcctccaacttcccctaccttgaagtctatgttctgaatcattttttcatttacagtcatttttccagaacattacttggtgatttgtcatctgaatctttgcattctaacaagtatcattcttccattttgattagtgaatgactggatgtaagatttgagggttgtatggcttgaagagatatgttgatgttaatttactattttctagtttttggtattgtaggtaagaagtccaaagccaatattactttttcctttgttagtaacccaatcttcctattaaatatttggtagcttgtaagattttctgtttatttttgaaattccaaaattgtaccaggacatatttaggtttatgtttttgttttgcttttttttttaaatcaatcttggctggaacttagtaaaccttttcaatttccaagtccaactcttctcaaataaataaaattttcctcttttcccccctatctcttcctttatttccttatggaattcctattggtagtatgtcagtctcttgctctgtcttcttattattttctgcatgacttctatcttttgcacttttgcacaatccttggagatatttctaccacttgatcttccaagcaactaattgaatttttgacaaggactgtaattaccttcatctactaaatcttaaaatttgaaaatcacatattttgttccagaacacagtgttaatgtcataattgaatctgtattagtgttttaattgcttattattgttattaaaattatctattgccccagaagttttatttctctaggtatcctaaatattatgctcattcttccactctccagttggttgttacttaggttgctggtattttcctctccctactgaaagttcgattcaccctaagggttctggaagctgctagggtactttgggcctggtgagaatggagttacagtgggaaagaggatcatgagtggcaaaaggaagagaagtgtcaattcctgaattagcaaagcacaaaatggcaagctgctagtcttctattaaagtacaaaaaataaacagtccaagcctctgtgcttcctggacggttttgttgtgaaggctggactttcccagcctttaaaggatagggcagtcttagtattttttcaagtagacttcagacttctgggtcaacctaaaaaaatttatagctttgcccttgatctggatcccaaccaaccacaaattcttagaatcagtgaatgttagagatgaaaaagacatactccaaatgtcctcattttatagataaagagaataatacccccttccccaaaaaaatgatactagtttttcaggatcatctaggtagttagcagtagagataaaacaggattctagactttgtgacactcaggtcttcaattaatggctttatcttctgttgcctagtacatacattcttagcattaaagcaattgtcttacagaatgttttcatgtaatattggtactctaagagaacaatggttaggtatttaattattcaaatgaaaatgaatgggaagtgttagtaaatcaagattcatgttagtattagaattatttttggctaggcgcagtggctcatgcctataatcccagcgctttgggaggccaggagttcaagaccagcctggccaacatggcaaaactctactaaaaatacaaaaaattgccaagcatggtggcacacacttgtaatcccagctacttgggtggctaaggcacgggaatcacttaaagccaggaggcagaggttgcagtgagtagaggtagcgccatgcactccagcctgggtgacagagcaagaatctgtcttttttttttgagaaggattcttgcactgtcacccaggctggagtgcagtggcacgatctctgctcactgcaggctccacctcccaggttcatgccattctcctgcctcagcctcccgagtagctgggactacaggtgcccgccaccacgcccggctaattttttgtatttttagtagagacagggtttcaccatgttaaccagaatggtcccgatctcctgacctcgtgatccacctgccttggcctcccaaagtgctaggattacaggcatgagccaccacgcctggctgactctgtcttaaaaaagaaaaaaagaattatttttcggccaggtgcagtggctcatgcctgtaatcccagcacttttggaggctgaggcgggcagatctcttgagcccaggagttcaagactagcctgggcaacatggtgaaaccctgtctacaaaaaacacaaaaaatattatccaggtgtggtggcgcactcttgtggtcccagctactcaggaggctgaggtgggaggatcgctttagcctggtatgtggaggctgcagtgagctgtgatcacaccactgcactccagcctgggtgatagagtgagaccctgtctcaaaaaaagaaaaaaagagatttatctttaaaggaatggctaagcaccatccaaattaaattaaaactgcagttgttaatgaagaaagatttaagtgatatcatgatatccctttaagatatgccactctttgtgaaaagggaaactactgatatatacctagaaaacttaatctgcttaatccaatagcccctctagtggcagtggtgagaataagtcaaattttagaagtacaaattttgtttctatcagtatttggtatatacaaataagatttatatatttatataaatgctgataaatagcttttatctgaaggtgttttatgtgtaacaaagtgtctttcataatgcaaatattactatatttagaagaagaatagagaaaacacaggatgagtttgaacctaatactacctatgtgaacctcagtgtcctcttttgtactgccttcctcacagagttgtgagattaacacataggtgtgaaaatgtattttttaaaaacattagtattgtcattaattatatttcttggatattaattgatcttatatgtgggaagttctgtcttaaatataaggtcagattataatgttttgtagttttagcctcctatcattgagaaaattaatataccctgcttgctttatgtgagaaaactgagaaaatcatgaactgttttctctctattatattattcatgattataacccttgttacctatttcctcttatcactattcagagtaatctttgagttttagaaagaaaactcagtttttatatgttaaaaatgaagagtctgggggaaggaatatgaagtaaatattggaaaatattagcatttgtcaaatctgagcgatggatacatgggtgtttgttatactgttatgttggaaatgttttataatttaaaatatagcatgaatcataaaaaagaaagcaaatttatgatgtgaataggcccttaagctatggttaaccaaaatcatagttttcatctgaacatgggattctgaatcatgttcatttcattccacagagtgatagtaaaatgttcacacatgcagttttctgctggttacctcagacaaatccatacctcttgccacagcatcctctcctttttttttttttttttttttttttttttaaattattaagagactaggtctagggccaggcacggtggctcatgcctgtaatcccagcactttgggaggccaaggtgggcggatcacttgaggtcaggagttcaagactagcctggcaaacatggtgaaacccatctctactaaaaatacaaaacattagccagccatggtggcggacatttgtaatcccagatgcttgagaggctgagacaggagagttgcttgaacccaggaggcggaggttgcagtgagccgagatcgcgccactacactccagcctggtcaacaaagcaatactccatctcaaaaaaaaaaagagagagagagactaggtctcactacatcacccaggctagaatgcagtggctattcacagatgtgataatagctcgctgcagtcttgaactccggggctcaagcaatcctctcacatcagcctctcaggtagctgagactacaggtgtgccaccgcacttggccagcatcctctctttctgatgattctggacaagggtccgttctcattagactctttcttttatggtatattacatgcctttaaaaaactacacaatcacttctgattaggcagggagtggaacaagcatttaataagaagccagagtttgtagtcctggctctgccatttactgctctatctacactttgcctctctgaatataacttgccttttcttaaaatgagcatagtaataccttttcagtctagcatacagatttgttgagagattatagcatgcaacataaatgaagttatagatcccctggctgttgtcatatgttggtacctgtctctctagtaaggcaggatgtctgatcaaatctccagaagccagaagcgtacaacagaaaggagagttacagagagtagcaaagggggatagagtatggcaggacccaaataactggcccagcagtgacaatggacaagataacatttacaactttgagattcaatgattttgtgaatatactacccacagagtacaaagtatcattgagcatattctttgaaacatgataaatttcagtaaggatttggaacaaaatccctttcagctgatttctgcaaattagaaaatttcatgtagagaattgatgtctctgaggtttcacaaaataggaaaaaaacatgtttcccagataacatgaaaataatgagtaaggctggcacggcggctcacacctgtaatcccaacactttgggaggccaaggcgagcagatcacctgaggtcaggagttcaaggccagcctggccaacatggtgaaaccctgtctctactaaaaatacaaaaattagcctggcatgttggcaggcacctgtaatcccagctccttgggagactgaggcaggagaatcgcatgaacccaggaggcagaggttgcagtgagccgagattgtgccattgtactccagtctgggcaacaagagcaagactccatctaaaaaaaaaaaaaaaaagtacgataaagcactgaaaagtacttatttatagtaatcagctaggctccagaacctttatccccctacagagatgaataccatgatggtgtgcatctcactgctgctttgtttacagtagctttacaataattctatagaatcaacatattgtagttatatattacaaggtttgtaaaattagctaatatctttttctactaacataaaattatatttgttgatagtattcattacccagtcagtattttgaaccacattccatgtgatgctgtgtttgggatgttttttccatttactccatagtaaatgaggaaccattggcttagcataatgataatatgatccagcaaggcaaggagcccagaactctgggcatcaggaacccatcacatgcatattgtgtagtatttcaatacaacagaataatttgctgtcttttttcctaaatcgaaatgaaaaggatagatgagaaatctgttcaaaatacataggtcaaaaatacgttaagtacaacattattcaaaataattctgagatgtttgcccaactagtttaactttgaaatttatgtcagggtttttttttttaagtctttaatgttttacacatagattctaccttcagttaatacctgggcacttttttggctgcctatgcaatgactgactgaatgactttaaagggtctctatgttggtaggctgaaccttatatgagccatttttcaaacttttacttttggcccttctccttgggagcttgcttcccagagtcagagcttgtggacaggccagtgctagaggaaagggagaattttacccagaccctgtaagagaacctcatagtaaatgaagctattcaggttggaaccaggcctaccttgccatttggacctttcatatttagctctgtgaatgtatttaagtcccagtctatgattttcttgtgtgttactcatgagtattttccagaataaaaatcccaagcatgctatagtcgaactttgccagtttgttgggtatgtttgtgtgattaacttgttaacatagcagcaatagtaatgacatatgactttcttgaaaacctagtttgttccaggtactattccaagtgttttatatgtattaataggatgtcatttaatcctcataacaaccctattatggctactttacagatgaaaaactaaggcaaagagaagttaagcaacttgtgcatggttaaacatctagcaagcagtggtgctaggatttccactcaggcagtctgactccagagttcacattcttaatctctgtgctatgccacctcctgactagcttatctcttatagagtctgtgaaggttgtgtctctggtaggtctcaagttctgcctacctctgtcacacctggataaaaattgaaattatatcctagttacaaatcatgctatcttgagtcactaactttccttcttcctctctcatcaaatagtgcattaaggtaagggggcatgaataaacttcactgccatgagatatttgtgagaacatatgctgtctcgttgagagatcatttgttttcaagttaacaaaaacctgctgaagctagtgcaagcaaagaagacatttatggaaggatacaaggttatctcatagaacccaagagcaagaatacagctgggcctcaagggggatgaaaggcaggtagccagggttactccctttttagttgttctcattagatgtccatagggaagaaagggaaaggaagagtcaggcggtataaataggtaagaatttttcagacaacaagagtatggctagatatatactcctcaaaaagtatattttctgtactgcatcaattgaagggaaataccaattacaggtcgcattgcccagtagatttgtatggatttaaagtaataactaaacaatccctttcaactattcccaatcatcctgtcccttcataagtcttgattcttggcattttgtttattctcacttgatcagtctcaagttaggacttttcaactgttctgacacccaaagataagacccctgttttcatctcttctccccagaccttcaacctgtaccatcaaagagcctgttgcacttgccttttcaagtgacagtcaggaacctgcctagcttccattcctaatattaatatcctatatgagtagttcataccatctctgctttccttgtccttttccccctaccttttctcttcccaacattatgaatacctactggcttttcctatttctagggatcctcccccctccatttcctattagataaactccaaattcatcagcttgagggttcttcaaaatcatgtcccatcctaactgtcccagtcattcccactcaagtccttcactctaagcaggccattttccacagtgacctagaaacagcacaggcttaaccattattccaagcctttgctagtacagatcctcttgattacaaagctctttcccattcctttcctttccacctctctgaatccagctcatttctcagggcctcacctaagacattctctctaaagagtcctatgtgatctttccaacacctcaggtaaccaattgtccaggattgccttggattcctaggacatctgactttagtactaaaacaggaatattcctaggcaaaccaggatagttagacatcctccaacatctcattgtctcctttcattatagtggcttgttagaataaaaagccctgtgaaatcgccagtagccactacttcagcatgtacaaggtcctttctccataataagacttaatgctcctgttaggcagagacccttttgattcccacttcatacagaatatagtgctgtactcatgttaatgcctattagtgaataaggcgatgtagttttaagttggcactatatctaaaatcttttccttgtgtgttaatttctttgtctttatttttttccagcccagatgacttactcaatgccttgaatgagggtatcagtcgtgctgatgtcatcatcacatcagggggtgtatccatgggggaaaaggtatgaaagatagggctcgtgaaaatgtatctgctgtaatgttcttgcatatggtcgattaactgtggtctggtaggcatctgatattcataacgaggctcccacaaagctgaaaatccatggggcttcagaaattactggtctctttaaaagggatacaatgtgggtaggtcagggagcttaccctcaggagcaacctggagaatcccacaacttacagaatggtttttgctattcctgtggaaacttctgacctgtttctcactctattttactacattaggacatcctttatgcatgatatttaccaccagggtaaaactctaagatccttccttctactcaaatttaaacatgactccccaggagccaaccaattcacccaccatatattccaaatctaccaagaatgcttagctccccttccccacaaggaagaaagggaggattaggcattccttttgctcctccttacaaaataatataataataataatgaaaatatggccaggcacagtggctcaagcctgtaattccaatactttgggaggctgaggtgggtaggttgcttgagcccaggagttcaagaccacctgggcgacgtggtgaaaccccatctctacaaaaaaaatccaaaaattagctgggcatggtggcacgcgcctgcagttccagctacttgggtgctgaagtgggaggatcgcttgagcctgggtggtcaaggctgcagtgagctgagatcacaccactgcactccaacctgggcaacacagcaagaccctgtcttaaaaaaaaaaaaaaatatatatatatatatatatatatatatatatatatacacacacacatacacaaatattttataggactaagtgtatttgtagatggtatatacttgttcctataaagaccacaatttgaatatttcagtaacactaagtttacatttcttaatgaaatgtgttagtttacgatgactattgggtctactgaataatgttataaaagtaaaatattgtttactaaataaccaagcttaatttttggctcaaagatatttcagtgtaaaatgttttgccagctgataatccttttccatgttttctctcacattaatgactaaactgaaaaattacaaaaatactgtcatagcaatttttaccaaaattcatattttctaagagtttgatttattttaaactagatcttacgtatatgattgttcttgatctctgtcctcttgtagctataaaactgcctaaatttataacctgactctttggacagtgaactctgttggctcggagaacaaatgtcagaacttagcaacctgaacagaagaatgcctgccttccattcacaaactttagtgtcagagcctttcagaatagcactgcagatgctaaaaagtttggaagaaaaaaatctcacattacatccaggagtgaaagtgttgtagtgtgtgtaggtgttcttaaagcagacaaattgctggattagtgttccctcaaagtctcccagagtctttagccccaggtagagcaaattgccgcagagctctcctgagatcacaaaggctaggggctgagatctgcactgtagtacagctgaaagaaataatttgcaacttgtctgttttcattaccatcaaactgcctgtggtactctcaatattacaagagcaaaccatgaagtcaggtctatttaaatgttaaatttgttatttccagggtttgtgtcttgttataatttctcttagtttctgattaacctaattgtgggataatagctatttggcagaactaaaacgtttatcttttctagtactctggagaggtaacaaactcatagcatacataggcttggcaattgtggctcaattgtggtaaggacagaacacttctcaacctaaccttctttattagtgctaacaaagatgtcagttatgccagggatttgctcaccagtaaacaaagccaatatagttaagcatattggttttattttttttactctctgtataataagatacttacactaaacctttaatttactaggaaagaaattttagaaactgggcatcccacggtattccttaggagctgctaattgtcccttcctacctccttgagtgggaatgagatgatagaggaaccaggaagaaagagataaaacatacatgcagcaaattcctgccagcaaacaagttttaattccaaaaagaatttagggtacctccatagtagaaagaaaataataaaagacagaacatttgcttcagcccaggagctaagcctgaaaaccagttactaaaaagacagggaaatcaaggaaaaattcagaagtattatgtagcaggcatgaatattaagtgcagaacctcaggtatgcaagaaatgtatttaattccatttaaattatactctaagtgcctatgctacaggactggtgggaaattttattaagccacaactggagcttactatctccaagaattatgacaaggaacctgaaggtacttaagcagcaccaaagcatcagggagacacagctggtcactggtctgcactggatacatctagagtattcttatagtaccattagatctcaagtctttgctcctttgggccatgctaggagcactaagatcaggtagaggctggaaacctcagagcagctagcctctttgggtgtatttcacagccatcccttctaaagtctgaccacttctccaacatactgcatgctaaacagcgaggaaggggccctgctgcttgttggactcatagaccagtaccttcttcccagccaaggagaaatgattcttccacagttacttccctaaagatctctcccctccttcacctcaccctgccctacatactcttttcaaagagtttcatttttacaaaacactgaaagcttgttaaatagttaaacagtatctgccttttgccatgaaaactaaagaatcatatgcattactataagttttcttcgacctacaaaattattaaataactcaaagacaatgaaaggtggcaataatccagaaggatgcactaaactggacaccagtgaccttttttgctcatttctaagtctcttaagttttgctaatagtgtctccaccaccccttatgatcaaagtaatcacatagatgataaccgatcacaaaaaaggctggtttcatgaggtttgcccagttatttagcaataagagtgttaattaaccatgtaagctccttgatttgttttgtaagtctagagccatgtagccttagaatatttaaaagtaattggctgggcacgttggctcatgcctataatcccagcactttgggagcccaaggtgggcagattgcttgaggccaggagttcaagaccagcctggccaacatggcaaaaccccacctctactaaaaataaaaaattagctgggcatagtgacacatgcctataatcccagcttcttgggaggctgaggcacaagagctgcttgaacctgggaggtggaggttgcagtgagccaagatggcgccactgcactcctgcatgggtgacagaggaagactctgtctcaaaaaaacaaaacaaaacaaaaaaaactaatcaatattccaaacatacacataaaaaaattttctttaatatttcatttatcctacatcattcttgttctgctaaatgttgagttagcagtctgctttcctgaagccatcagctttgatactacataaaagttagctaagctatatcacctcagaagcctgtactcaagaggttattgtttgatatctcaatagcaatgttaaagtgcctattactctccttttccctaatgctctaaatctgtctctgtttcgggcataaactattgactatagcttgtagcaaagccttcaggcaagcaccagagtaaaacagaaattctctgtggatgacaaatacttgagagctgtgcttaatttgcttccataaccaataatatcagaatagaagataagtgacattctcttttgagatacatatgtaagtatttcacagtagggttttttgttttgttttgttttgttttgaggtttttgttgtattttgttttttgagacaaagtctcactctgtcacccagggtagagtgcagtactgccgtcatagttgactgcagccttgaattcctgggctcaagcaatcctcttgcatcagcctcccaaagtgctgggattataggcgtgaaccaccatgccagcctagaagttttaatcagcgtttcctctgagggtaaaacagcaaaggcattgtcaaatttccaggaacttcccgtaaagcaaacaatttctgaaatatttctattaataacagtttacctataagaacctaacctagggcagactgagtatctcttctcagatatggcagctcctctcatgaaactttaaacaaatctaattattcccagcatttctttttatagatgaaaacaaacctgggattttctagaggccctctaggaaattttaaagatgagttttggtaagaaaagcacattttttcctaaattttggtctgatctttaaaaggcaaaaatcaaaaaagttattaaaaaagaatggggcacttgatgaagacctgagaaactacttggttacctaatttttcaaaacaataaaatatttgaaaatgaacatagaaggtaacatgactgtaaataaccttggctcaattcataaataaggaacctttgttcttcgcttttttatttctttaaataaagataaacagcacaaaaaggcaaattacacaaaaagaataacctttcttattgtaggacaggcgttaatcagtaccaaagaaagaagcacatcaaaactcagcaaactcactaaaattttaatatgtttctcagcttcacttcaaacacagttactagaaaccagggcaaatacaatctcatgaaagtttgtcctttattatgctcttttatattctggaacaaattgacactttagagcaaagaatagtcttcataaccgtaagggtccttgagaccttttaagaggacctgcaaggtcaacactattttcataataattttaagactttatttgcttttttttttttttttttttgagacagaggctcgctctgtcacccaggctggagtgcagtggtgccatctcggctcactgcaagctccgcctcccgggttcatgccattctcccacctcagcctcccgagtagctgggactacaggtgcctgccaccatgcccagctaattttttgtttttgtatttttagtagagacagggtttcaccatgttagccaggatggtctcgatctcctgacctcatgatccacccgcctcggcctcccaaagtgctgggattacaggcgtgagccaccgcgcccggccagtttgccttttttattccacttctctcattctctttccttttctcatgagtgtatgcttgagttcttccagcagctaaatgatgagtgatatctcatcagattgagtgaatcagatatgagaatctgacttctggtaacccagaagttaaagagattttcaaaattataaaacaacgcattgaaaataaattactgggctgggcgtgtggctcacgcctgtaatcccagcactctgggaggctgaggcgggtggatcacctgaggtcaggagttcaagatcagcctggccaacatggtgaaaccccgtctctactaaaaatacaaaaattagctgggcgtggtggcgggcgcctgtaatcccagctacctgggaggctgaggcaggagaaccacttgaatccaggaggcagaggttgcagtgaccccagatcatgccattgcactctagcctaggcaacaagagtgagactctgtctcaaaaaagaagaaaagaagttacttatgttaacatgaaatggctttattgttgttattttcaaatgaaccaaatgtttttttaatttcttagttttaatttctaatatagtaaatatccatagctatagctcacataaacaaaaactcttagggatccttaatgaattttaatttaagaatatgtgaaggggtcttgagaccaaaaattctgagaatcgggccttaagaaaaaaatattatttttccttgaaaaacaaaagaacacttatagttatacttctctgtcattattgttccttatataattgcaactacccatattaattatgatgtttaagaaaataactaatatctgtgtcatagagaaaactagggagcttggataattgagaaataatatgtaaccattttagcagactagcaaagctcataaacacaaagaacacaactttctactgcgggacacatcccttttacaccttagtgtagcaaagatgaatcaacacattcattaacatgacccaaaaatacagcctttccagcaaaatatattcaccttaagaagtacatagttactaactatatagttttaatttctatataattaataactatattctttttaaaaagctaataacttaaaatgatgcttaataataaatgctctaatactctatcttagaaattaggtatcttacgatgatttattaatcaattcagtttaatatcaactcaagattttaagtaaataaaaatcttaaattattttgaaactgacatactataaaacataataactattaacattgtaaggttggccgggcgcggtggctcacgcctgtaatcccagcactttgggaggccgaggcgggcggatcacgagatcaggagatcgagaccatcccggctaaaacggtgaaaccccgtctctactaaaactacaaaaaatagccgggcgtagtggcgggcgcctgtagtcctagctacttgggaggctgaggcaggagaatggcgtgaacccgggaggcggagcttgcagtgagccgagatcccgccactgcactccagcctgggcgacagagcgagactccgtctcaaaaaaaaaaaacaaaaaaaaaaaaaaaaaaaacattgtaaggttttcagaataattatttgattttgttgatcacagttttatacttttttataatcttaaatattatataggaaaaatgtgagattatttgataaataagcctatagaagtttaggaaaaacccaagtgaaataaaatgtatacttgtgttatacttaagattgatgtaaataagagaaagaacatggctgaggtttttttattattgttatttaagtttggggtttgttttttttctttgtttatatgtatgttttgaggcagggtctcaatattttgctcaagttggtctctaacttctgggcttaagcaataatcctcctgcctcagcctcccaagtagctagcattataggtacacgtcatcatacctggcttttgggtttccttaataactggaattattaagttagtctcatttgctacagatttatcctaattatatgaactcacattctcaaaattataagtagaatattttcagtgtagcatatttaaaatattgtaagttaaaattatttattatctaggaattttagaaatattttatataagaacttactatctctctcagccagttagaacagggcatctttaagagacgatataatttatgaataccttacagaaataggaaggcaaacacttcacactcacaaaatgaggtaaatgtttttctgtattacagacacgtgaacacacagacagataagaaacacaatagcttcagttctacttacaacttgagctgtaagtcaagagtaaacacagaaccataaatattcatcagtccactcataaagagctattttctttcctagagggcacaaaaatcttaattgatttggcctcagaatggacaataagagaaataaacaagaaagactaataagccagattctctgtcttctcttaaccaaacaaaatagatttgtatcatccttttacagagatcaccaaatgattagaccataaaaccaaatccctaatcattcctgccacaaggggcaataccttattggccgtgtgcagaaacaaaaacagaaccaaaatgaatacggaggccaaaatagagaaaccaaaagttaccaaagttacagttttattgctgcttggaattcactccaggaaccaaggaaagatgtaccctttgtttgtttgtttttgtttttgtttttttgagacagtgtcttgctctgtctcccaggctggagcacagtggcatgatcttggttcactgcaacctccacctcccgggttcaagcaattcttatgcctcagccccacaagtagctgggatcacaggcgcatgccatcatgcctggctaatttttgtctttttagtagagatgctgtttcaccatgttggccaagctggtctcgaactcctggcctcgagtgatccgcctgcctcagcctcccagagtgctgggatttcagacttgagccaccatgcctggcctgtacccaggtttaagccactcataaagtgtacttctctgccaatgaagtttaactggctctgtccaatgaatcaatggagcatctcagtggagcctctggaattgttaaagtttaactttttatagataaaatcattaatcttgattttgtctcctttcttggcttactcactgtacctcgtttttgtaaataaatttagttgtttcataagtgttcatagtatgtataacttctatattctacctagaagtgatattaccacttcgtgtatagcataagaatcttacaatgatatacttctgtttttcccctctcaacatctgtgctacacttgccataaatgtcatatttacatatattattgaaccttcactatatcattatgatttttctttaaatgataaattacttttagcaaatgttatatgatatttaaaaatcttacatatttgcctatgtaaaaaaattatgaatctcataaatatataaaatgaacatgtttccaagactttatttaactcaacaacgagcaaataagatgctatgacctattcaaaggagaattcaaagaatatacccatttcagcattcttgactacccaggtaatcaggtaatcaagaatgctgaaataatttgctaatagatgcaaaactgatctatacccaccacagaataatcaattacatctccactgggcagaattcatttgcatttctttggaataaaattatgttcactggcggggcgcggtggctcacacctgtaatcccagcactttggtaggccgaggcgggcagatcacgaggtcaggagattgagaccatcctggccaacatggggaaaccccatctctactaaaaatacaaaaattggctgggtgtggtggtgcatgcctgtcatgccagctactcaggaggctgaggcagcagaatctcttaaaccagggagtcagaggttgcactgagccaagattgtgccactgcactccagcctggtgacagagcgagactccgtgtcaaaaaaaaaaaaggttcactgtcttagcttaggctgctatttaaaaaataccaaagtccaggtgcagtggctcacgcctgtaatcctagcactttcagaggccaaggcgggcagatccttaagccaggagttctaaaccagcccaggcaacatggcaaaatcccctctctacaaaaactataaaaattagctaggcatagtggtgcttgcctgtagtcccaactagtcaggaagctgaggtgagaggtcaaggctgcagtgagctgtgttcacaccactgcactccagcctaggcaacaaaatgagaccctgtctcaaaataacaaaaaataccataaaatgggtggcgtaaacatttatttctcataattctgaaggttgggaaatccaagatccaggtgacagcatggatgggttctggtgagggccctcttccaggctgcagatagctgacttcttttaccctcacatggcagaaagagagctagctaactctctggcctcttcttataatggcactaattctactcatgagaactccaccctcatcacctaattacttcccaaagcccccaccatcacattgggattggagtttcaacatatgaatttgggggtggggagggacatattcagtccattgcatttactctcagttttattcagtttcattgctgtaaaatagctgaaaaatacaaataaccagaaagtgggtgttgcactggacacccagtattcttttctgcccatttcaaagttttgcacaatttttctgaccactggtgtttctccttacctgagttgaagaagagacttattccttcatccattcatttttcttcttctcatatgactctggggttcagaatatcagacaaagatccttgctgcttcaataggtaaacaaaaatataagaacaatgatgattctcagcctttatcactatgtctggtacaagttttctgtctgtcacaggagcatgaagcacttcttcatgttcaaaaagaatgaaaagggctatttttaaaaacaattttttgcaagaaaaataaaacactttcattcatttagcaaatatataagcatctgctttccaaactctgcatcataaccttcaaggccctgcaactctggcttctgcctatctcttcaaactctgcttatacctctctcctactcattcactaccatccattgccttttcagttccatgcacgctttgccactttggaagctttcatttgtatgtcccttctctggaattctcttccctccacacttcacatgcttgaatccttcttatccttcaaggcttagctaatatatcactacctcttctagaatgacctttcctattccccacaccctcatcattttctatcccagcacctgcttatttccttcatcgcatgtaccacaaattataattattttatttgttggtttacttgtttttggctatttctctccagtaaaatgtaacaggatatctttgtgtcagggactatgtctttcttctgtaccatgaaatgcgtagcacatatggaattcctaatacataataggcactcagaaatgtttggtgcactaacaaatgaatgagtgaaaggtgtatgctattcattaaggattcattatatagatatagatatatatagatatatataaaagagaagtttcctgttctcaagaactttatagtttaacaaaggatacatatcagctatcaaagcagttgctctataacctaagtgcataatgttagaagcatttagtgctataggagcatataagaaagacctgaagatttctgcttctgctatgatagaatagcatatttggaccaattctcccaccaagaacatctataaaaactatgtaaaattttttaaagaaaagcaaaagcagatgtctgaagaaaataaccaagacagccaggattccgggcactaagatcccagagaaaaagtgaaccacagagaagtaaaactggaattcttcaccatatttttcctcaaagcatttactaattcctaagccaggagtgaggtggggtgagagctattaatactacaggaggcaaagaagccaagcataaaaaagagtagctaagaagctaatgaaataagcagaattttcatgagtcttatgagttcaggacctgttatagaggaggggccctggtaaatatctcaggctttcagcttgaagggctatgctttaggaataaagacaatctgcagataaactagccttcacacggactgaaattcagcatcaaactatctcaatccctgattagatcaagataatctgagttttccttaactgccagaagacctcaaattctttttggaggaatatatcattgtccaaagccttttcaattttttcatacctgatatttgggcttcaatctgaaaagttgccagacatgctagagatagagcaaaatgactaaaaattaagataggaaacaattgataaagtagacctaaaaatgatgctgatacttatattgtctcacatggactttaataaccattatatgtttaagaaaaagggatgacaaagtgggaaatttcactagaaaactggtatctattcataagaatcaaattgaaattttggaaaagggatagaaaatatagaaatgagcataaaagacaaatgggatgtggtgaaaggtcaaacatatatgtagatgaagtctaagaaggagaggggagacagagtgagcaaaacgatatttaaaatattggcggatagttttccaaaatcaataaaagacatcaagccagaaattctaggagctctactaatctcgagccggataaataaaagaaaccatacctaggtaatcagcaaaactactgaaaactaaagacggagaaaattttaccagaaggacacattgccttcaaaggagcaacaataaaactaacaaatgatttaaatggaaatgatggaacccagaaaacaatggactgggatttgtaaaatgcaggaaaaaaatactgccagtagggaactctatagtcatcaaaaatgtacttcaaaaatgaaggtggagtaaagacaatttcagccaaacaaaaactgtgcggacctagactaaatagagtttttaaggtggaaggattatggaagcatggaaatgcagaaaggactaaagagggttaacatgtcagcaaatgtaaatgagtgttgatcatgtaaaataataatgtcttgtgaggcttaaaatatgaatactatatagtgaatatataaatatcaagtatatattgtcaacatagtatatgtagaaaatatatacaataaataaaatacatatacttaaaatataaacatatacatgcacatacgtatatgcttaaaatgcatgtaaaatatatacacacaatagcatgaaaggtagaaaggcataaattgagttgatatgttttaaggttcttgtattgtctgggaagtgatttttaaaaacccagttatgagtagactgtaataagtcaaggatgcatattgtaaatctctaaaataattactaacataataatataagaatatgtaactaacaagctaatagaggggaaagaatattaaataaaaaatatttcatgaatcctaagggaggtatagaagaaggaaaaaggaaatcaaagcagaagtgacaaatggtacagtgatagttttaaacccaaatatagcagtaatcatactacatgtaggccaggtgcggtggctcatgcctataatcccagcactttaggaggctgaggtggactgatcatgtggggccaggagttcgagaccagcctaaccaacgtaatgaaacctcgtctctatacaaaaattagctgggtgtggtggcatgtgcctgtagtcccagctactcaggaggctgagacatgcaatcgtttgaacccaggagacagaggttgccaacgtgagccgagatcgcgccactgcactccagcctgggtgacaagtgagactctgtctcaaaaaaaaaaaaaaagaaaaattatactaaatgtaaatagactgaatccttcagttaaaaattgtcattctggatttttaaaaaaacagctaatcatatgctgcttataagagacacatcttaaatattataaagacatagaaaactgaaagtaaaagatttgaaaaagttacaatgaaatatagctggtgtagctatattgataacagagaaaattctttttcttttcttataatacatttttatgtagagcaaatagagaaaattaaggtaaaaaggattactagatattaggagggacattttattattttaaattagttaattcatcaggaatatgtaagtaacatttgcaaatttactatatctaataatataacctcaaaatgaaaaatacgtgaattaattaattaataatcaacatttcatctagtcccccagtctttggagttcagaggaggctgagaagatgactgagactaagataaaggtgggatagacagtggggtagaaagagtattcaaggcagaaaaaagattttcaaagactggaggcaatagcttaagaaactggccagatgcggttgttcacacctgtaattccaacactttgggaggccagggtgggtggatcgcttgaggccaggagttcaagaccagcctggccaacatggtgaaacgctctctctcctaaaaatacaaaaattcgccgggcatggtggcatgcacctgtaatcccacccagctacttgggaggctgagggacaagaattgcctgaacccaggaggcgaaggtcgcagtgagccgagatcatgccactgcactccagcctgggtgacagagagagaccccgtctcaagaagaagagagaaagagaaaaagagagagagagtggcggcgggggtggggcaggggagaaggaaggaaggaaggagtcttgctagaatgtagacggagagaaagattgataggaatgtggctgggtgagatggatgagaacaatgattgggggggctagaaaatataggaatatttgatatttaaaagatgatatggcctggtgcagtggttcacgcctgtaatcccagcactttgggaggccgagacgggtggatcacctgaggtcaggagtttgacacaagcctggccaacctggtgaaacagtgtctctactaaaaatagaaaaattagctgggcgtagtggtgcatgcctgtaatcccagctactcgggaggctgaggcaggagaattgcttgaacccaggaggaggaggatgcagtgagccaagatcgcaccgttggactccagcctggaggacgagagcaaaactccatctcaaaaaaaaaaaaaaaaaaagatactttttcctaaaaaccagcaacttattaaagtattatatagtcacttgatcaaatttatctcagaggatctctgttactactgtggggagaatgaattggaggagggtggcactattggcaaggagacctatttcagcaatcccggtgagatgatgttggctgaggctgtagagatagaagggaacacatttttacaaataaaagtacctaatagtttgtgaaatatttaaaatgtagacaggttactggactcatttttagattagtaaaccaaaaaatttagtaatagacctaggtttttattatttaagagaaatgttaaggagtgcaatttttttctttctgtctacaacaccagctgcagagctgtgttatatttcatttccaaagatcagattttgtaatatcactgtgggttggtcatagccacaggttagttttgtttttaatactagaatataaagttggagtagttaaaactcccttgactttctgttttagagttcctttcctgtttttcattttagttgagctatttagatttgacaaatctaagtaatctgtgggcatatgttcaagtctctcttcaaggaatgtatatggctttaagatcattaagcagaatggtgtaggatacatacatgtaggtttcttgcccgggtacaacttaagacatatttgttaacatccttcttcagacataaaattctatcttagaagagaaacaataacgcaccagctaatgatattatacattaatgtagttgttttgtttttatctaacttctcctactagaatgtactttctgtgaggacagggatgttgtctcttttgttcaaggctgtatccccctacacatagactggtactcatcatataccaagtgttaagtaactatttattgaatgaataaatggataaatgaagaatgaaggaatatttgtgttaagcaaatcaactccattaaaataagaaagatgtttcttttcatttcaatcttattaatttaatgttcatttaaagtgttgaaagtctaatattaaaatgtttgaaagtaaagtgattatttttaatgtttgcaggactatctcaagcaggtgctggacattgatcttcatgctcagatccattttggcagggtttttatgaaaccagggtatgaaaatcatcttgttatctcatatatggggttggtttggcttgctttaactaacaaatttttaaatgccttctttttacatttcctattatgaattaactattccaaaaaaaaagaaatatagtattaggatcctttgcacaagtgcaggttctaatgaaataggaattcatcttccttatgagtcaatgagtttggtataaacaaaacacagcaactttccaaactttttctcctttttaattctcatccctagttccttcttcctctttttctctttttccccaaactgcttctttatctgtttttaaaaataattaatatgagaactctgaaatatacacaaaagtagggaacgaacccccaccccaccctgccttttagttgggagggagggctggtttgtttaaaagcaaattctagatatgtcattttggtatacatctgaaataataatactaacaacagcattctcttacctaatcacagtagtattatgtcatctaacaaaataaataatactttaatatcatctaataccctgatcatattcaaatttctcccatatatcaagaaaaagaatgcctttttataattgttttgtttgataaggattccattaaggtcgactcagtgtatttgtttgttaagtctctattaaatgagaacattttctgcccccaccctttttgttgttgttgtgccattgacttgctagagaaaatggatcatgtttcctgatgaatggatttggctgattacttccttaggttatgttcctctgtctctgatatatgctataaattgaaagatataaaggcttgattaaattcaggtttaattttttttttcctttgcaagaatgtttcattaagtaggctttcacactgtttcctactggcccctaggaggaaagaaaaataactaaggaaaataaccatgaatttgcacatctcttaaaaattaataatccctaaagaagggctgatggaggtcctgaagtcagttataaatcctcaaaggttgccaaacgttggtattagtgaaagatatggccatatctttaagaaatagtctatctgtttagacctttgctactctatgaacctatgatttcctgtgcagagacctcaactgtatggctgagagttccagcccacctccatgctgtcagggacaacagtaatgatgctttactgtcaatgaaccctaggagagaatggagtagaggcttctcagttgttgtaagtgagctatgggtaccatcaacaaatttcaaaagcctttaaagtatcaagctagccctcctaataagtacctcatgtcagttctaggatagagatcaggctttacctccacgatttggccatttttagtatagaattaagattattcctaaagctttgtccacaatttgatagaattcttggctttgtatttctgtagttgcatgttgagcatgccccaatatggctgctgctgatagggcctttttattatcgaaactgttgaattggggctgggcatggtggctcacgcctataatccccaacactttgggatgctgaagcaggcaggttgctttgaactcaggagttccagactatcctgagcaacatcgagaaaccccatctctataaaaaatacaaaaattagccgggcgttggtggcttgtgcctctagtcccagctacacgggaggctgaggctgaagaatcgcttgagctgggaagcagaggttacagtgagccgagatcatgccactgcagtccagcctgggtaacagagtgagaccttgtctcaaaaaagaaaaaaagaaaagaaaagaaagaaactattggattttgtcttacgcaaatattgttatgctattgggtataactgcttttttttttttctgagcccatgggcagtactaatctgattaggatacagaggatatcccaaaagcatatcagtgtgcttctcaaaacctcaaaaattgaattgggccgagtgcagtggctcacacctataatcccagcattttgggaggccgtgggggtggttcgcttgagcccggaagttggagaccaacctgggcaacatggcaaaaccccgtctctacaaaaaatacaaaaattagtcaggtgtggtggcacatgcctgtagtcccagctacttgggaggctaaggcgagaggatcacttgaggcggaggtggcagtgagccatgatagcaccactgcactccagcctgggcagcagagtaagaccctgcctcaaaaaaaaaaattaattgattgttctatttgcagagggaaagaagccaacacgacttgcccttacctctagagaagagttatttgtgtaatatctatcatttaaaatattctcagtgcctgtgataacttttatactctttttttcaatctgttatttaccactcacttcaactttagcagttcatcaattcctaacattttatttcctcccttaaaatcataacactctgacttcagccattgtgtaaatgctgttatagtctgagctcaagaggagaactgaataataggttttgagttccaaggaaatggcttccagagcttaaaaaaaaattcacagtttagcaataggacatttatgatagccatgcataataacaaaatatttttttgcaatggaatccttttttaaatgagtaactttacagaaattacattacctacctgcaagatgcaaaagattgcttaaattggccctataatttcaatgggctttaaatgcagtggaaggaagaaggtgttatacattctctcctcattcttattatctgtaggtttgctaaaataaagtagttttgaagtttaaatgggcttcttttagttcaccagaattttatgcttgtctaaaggtaataagaacttaaaggtaattgctacttaatattagaacaaaagaaatataaaacacacaaatacaatctggctttgctatttccacgtaacagtgctttcagaatgcaattaagctctttcattttagagacaaagatactcagaaaagcatttggagtatcagcaaccagatctaccaatcacggtttttattgcgtcatctacagtgagcatagctgttattaagaacaaatctttgaaattatttgcatcacacactaataatcattgccaaataacctatccataaatcagtatcaaaatcgaatctcatttttctaaaacagcaaagaatcaggaagtatgctaaagaaaagcctcagagtagccaaaatagatgtccaaagatcatgtactaacgctacataaccatcctgtgagatctttatccacatatcagctaaagttagaacaaccttggttcaaatctgtgttcctccacttagtagctgagtgacttggaccacattgcttaatctctctgaatctcagtttccatataaactgggattctaattgttaccttataagcttgttgtaagacttaaatgaaataattaatgtgatacatagatgttacttaaaaaatagatattttagccaggcccagtggcccacacctgtaatcccagtactttgggaggctgagacaggaggatcgcttgagctcaggagttcaagaccagcctgggcacatagcgagacctcatctctattaaaaataaaaaaaattaggtgggcatggtggtgcatgcctgtagtcctacctacctggaaagctgaggctggaggattgcttgagcccaggagatggagactgcagtgagccatgattgagccactgcactccagcatgggtgacagatcaagaccttgtctcaaaaaataaataaataaataaaaatagatatttttattattactgttattatgttcattctaacaatataactattgctactattctctggttctcaaacctaaaaccagctttaatggtcaagatgatagcaatctcgcattacagggtgccacaggaaaaaaaaaattgggaaggaataaaaaaacagaaacaagaactatagaaacatagcaatgtggggttatggtttatgggtgaaaacaacccatagtactcttgtgacctaacatcactgtattacagcagagtagtacacattaataatgatggctataaatcatcaaaagaagtcagtgtcactgtattattgcaaaaggtaaagagtgagagatctatttttgaaagatcaacctccaaaaagagtaaaaataaaacaatgtgagtgcttaaaaggttaatatttcatctgtatgaaaaaagtatgccctaagaattctgcattgcttaaggttcattaatataatgagatttattagctaaaattctatataaagggtaattaatagaaaaaaaaaacactattctcaactgcccactctatgccactcactccttccaccccacctcctatgataagagttcatgtcaaaatcttgaggaagtgtaatttgagaatatttttaaattactattaattgtggctgggtgcggtggcttacacctgtaatcccagcactttgggaggccgaggcaggcggatcacctgaggtcgggagttcaagaccagcctgaccaacatggagaaaccctgtctccactaaaaaaacaaaattagccgggcgtggtggcacgtgcctgtaatcccagctactcgggaggctgaggcaggagaatcacttgaacccgggaggcgggggttgccgtgagctgagatcacacccttgcacgctagcctgggcgacaaagagcaaaactccatctccaaaaaaaaaaaaaaaaaaaaaaactgttaattttgttctagtcatgatattttatttattttgatatttcaaaaataatgtcttgataagagggaagtgtttatgtctatgctaaggatagttttaaaaggctaatacagaaggagcaggattgaaagaaaaaggttaaaaaatactcattttgaacaataggcaactgtctgatagacatattatcaggtaatctgctttctttttttttgagatggagtcttgctctgtcgcccaggctggcgtgcagtggccatctcagctcactgcaacctctgcctcccaggttcaagcgattctcctgcctcagcctcccgagtagctgggattacaggcgcacaccaccatgcctggcaaatttttgtatttttagtagagacagggtttcaccatgttggccaggctggtctcaaactcctgacctcaagtgatccacccccctcagcctcccaaagtgttgggattacaggtgtgagccaccatgcctggccagtcttctgcttttaagaatgattgttgtaaatcgccagcaaaagtagtataaacattattaactagaggggtgggaaaacttggaaactccaagatttggagtacatttctatggcactggcaagaaaaaaaaaaaaagtaagtagttttctttaaaccagaaagtgtggttacttgaaaacaggaaatactaaaaacaaacttatttaagtgtctgtggaatacttcagagtataaagatgtaaaggcaagtcaacagaaaagtgttttttatatgataagtgtatggattacaaaaacactggagtacttaatgtattcatcatattgcttagcaatcactaacaagtgactctttttttcttctagcttgccaacaacatttgcaactttggatattgatggtgtaagaaaaataatctttgcactacctggtaagaataacaaattgtttcctttcctttttctggaaaaatagccaaaattttttggacttctcatgtgaccacctggtttgaaatctgaaagacctgggctcaagtctcagcttttctaaacgaccaatcacttaacctctctaggaagtttcttcacctataaaataagactaatatctacttcatagggttggtgtgaaagtcagattagataatatatatcaaagcacattccaaatcctatcaaagcacattccaaatcctaagatgatcatcaagtgttagctgtcactagatctttctggagcacctgctttttccttacaggaaattggtcgaagttagcagccgaatacctctcataaccagaagtattgtgctctagaggccaaaatgccttgagtcacccaagcaaataccaaatcaaaaaatacaaagctgcctctggtccttgccagatttgggctggttgaggggagggggaagaggaaaggccaggctactggaactagtgcttctcagccaaatcctactcatcatcagtctacaacttccccactcccacccttgtcccaacgtgagcagaaactcacatgttcagattatagaaagagcaaagcaggttcagttcacgatgattttcaaattcaaattttttgtgatttggggttatataaagtcatggtgaatcttgataaattttaaaataatttattgtgcatcttttttttaactttaaaattatcttctgatcattctgttcagttctctattttttggcacagattcctttagaaaataacctatttctttaagatttacaaatctcatggcttttggatctttgtttgttttttaggtcaagtatatctcaaaatggaaatgtaaagaaatggaagcaggcagaaaaatgttaaactttgaaaacattttaagcccctatctataagcataaaagagattagatttctatcatgtagaaaattttcagagagagaacatttaagtaaaatagtcctcagaatgtatctgtaacatgaaacgccttaggacctttcataattccttggatgctctgatagccattgtataaagaaatgtgctccttttcctagcttcatttagcctggaagagcctcttttgtctacggaagatatgacttaacctacagaccatcagtgatattataacaaagaatgttactgtgggagcctatttcaccattatgccaaagatgttataaaattaaaacctgttttcaaattcctacttttaatttgaaaccttatctgctcagcctgagtgaaccaacagagggcagcagaaactcacatgttcagattgtagaatgtgcaaagtggttccatttacaaggattttctttcttgtttttgttgttattggttttgtttgttttttgtgttttgtgttttttgtttgtttgtttgtttgtttttgagacaaggtctggctctgtcgcccaggctggagtgcagcagcgcgatctcagctcactgcaacctctgcctcctaggctcaagccgttctcccacctcagcctcccaggtagctgggactataggcgcttgctaccacccctggctaatttttgtattttttgtagagacggggtttcaccatgttgcccgggctggtctcaacttctgagctcaagccatccacctgtctcagcgtcccaaagttttgggattacaggcatgagccaccatgcgcagctttacaaggattttcaatttcaaaagtgtatttctgctttcctgtaggccatgcgtttaaagccatccctaatctcgacaagttttaaatcaaagttttgtatatttacttgtttttttggacatttttaacattgctagagtgacacatgctcactattgtaaaaatcagaaaatatagataagcataaaaaagtgttaaccataatcccccaacacccacatatggataaaccactattacaagttttttatatcagtccttccagtcctttttcgtacatagcaagaccctgcctctaaaataattagagcacttcattttttatacagtaatgttataaagtggtagtattacatggattttataatccttgatttacaatggcttttttatttgttggtttggggtttttttgcttttccagaaaaaaatattctatctacttgtattttgaagcaagggaaagtaattgattctttttaagagtctgctattctgtgggcaactcatttttccatcgaaactattagtatcacttgtcactttttgcaccttaaaaaatctattcttaagcacttttgcaggtagaagagaattggaggtatgattatagctaataataggctaaactgaccattgccttttgacttgatgatgcaataagcagtgtttagccatgccaagggaacctaaaaatctagtagcccattccccactccaggttatacattcatgcttacatagaactgtataaaagtattaaaacaactgaaattttagaaccagaagagatcttgagaatcatgtagtccaaacctttcatttcatagatgagtaaagttagactcaaaaaactttggaacttgccaagatcagacagcttggttagataataatgccacacaagaaatcaaatctgttatttacagcccagtggttgtttgcttcttcacagcccacccttcctcctttgaagtgtacgacacacctagatttcttcttggagtgatatagtggaattcctcaaattcttctcataactttaaaagaatgtggtatttgtattagtctgctcaggctgccatgacagaataccatagactgggtagctgaaacaacagaaatgtattttcttacagttctggaagctggaagtccaaaatcaaggtgccagcaaggttggcttctggtgaggcctctctccctggcttgtagacagcaaccttttcactgtgtcttcacatgatctttcctgtatgtgtgcagactcctggtgtctcttcctctttttataagggcaccagtcctattggattacggccacatctttatgaccttatttaccttaattacctccttaaaggccctatctccaaatatagtcaatcatattggagttatagctttatcatatgaattcaatccataacagtattcatcttcaggtccttaaaacacttcttaaatcatttggtgtttttttttaatttaaagaaatatccaggtagagaagattataaataagtttccttatgcttatctatgttttctcagtttgggaaccaagcttgtaatactatagtaatttttaaatgcttaaaaaatagcaaatagatatataaaacttgtaaacggctttaaaacaagattagtaatgagtaatcttgataataagattagtaatggctttcagctggctctcaggaaagcggaaataaatggcgttaaacagcttctgggcagcagaattctccattttactgaaagacgcaaatgtttacaccccctgtggcatttagttgactatacctctgttctggttggattcaaggtgattcagaagaggaaaaatagtgcctagtcacttccgtcacattctgatacccaaagatatagacagacataattatttggcaaattgttacacagtgtattataaataactgcttggttgactttcagggaatcctgtatcggctgtggtcacctgcaatctctttgttgtgcctgcactgaggaaaatgcagggcatcttggatcctcggccaaccatcatcaaagcaagggtaatgctttctaatgaccagaaaccaaaatggaagcctggtaacagttagggatatgatttcctaactgtccaaaataaacatctagagttttctattagttttgatggaaaatgtgattatattctccccctgtgtactagaaaatgtaggagaaagggtccctttaattctcctacttcatgacttctaaagtgaatcattttctccagatagaagtccatatacgagtccagagagcacggcttaaaaacttgagtgatacttaaggacaaaacagtcaataggatatatctggctctaccctaacactagacctgtctggaacaagggagaattttcttttccccatgcaaactcagagggacagcaattaacctgctcactttttctgtgacttcaacgataaattttaaacaattcagaagaagacaaaggactacaaagagaccctggtgattcagggaaagggtaaccatattgtttagaagagaactgctaaggctgagaaatataccatggtaaaagtcacctggaaattaggtctccttctccaccaacactaacttcaatgtgatttactactactcaactaattatgttatacactttctctgtgactaatgaataatgttcttagcagtataaactacagtaccaaaccattactttccaagtgttccgaagtaaattcaaatatggcagaatgctatgattagttgacaggaagagcaaaaaacataaaagataaaatattaggccaggctcaatggctggcgcctgtaatgccagcacttcgggaggccgaggcaggtggatcacctgaggtcaggagttcaagaccagcctggccaacgtggtgaaaccctgtctctactaaaaatagaaaaaattagctgggcgtggtagtgggtgcctgtaatcccggctattcaggaggctgaggcaggagaatcgcttgaacccgggaggcggaggttgcagtgagccgagattatgccattgcacttcagcctgggaaacaagagcaaaacttcatctcaaaataaaaataaaaagataaaatattttaaaaaattacactgagaatacataggataaaaacattaaaaaaatctaggctttcaatagtcttaacattgactgtttaaatgctaagaactttgtggactaggatatgaaacaatctccttttcttaaaatttcatgaaaaatttaactagagtttttttcattaatcacagtggtaatcaaatttgaaattaagtggaaaaagaaataaaaaccatccatgaacaaaaagtattctgatcaagtcagaagtcagagtcataaagcttagatttagacagtcaaaccaatagtactgaatttactatcttcatatttactaaattaaggaaataaaaattcacattattataagagagagagaaagaaggcttccctttgactttgcagatctcttatgaattctttcacttatttctcattgtaacatccaccatctcttctttaaaacagacatagcagccatctattctgacaacaaagatgagatggtactttgtaatcagactgatgcttgatatgttgttcctgatggtgtccatttcctgtcagcaaaggatgttaagaagtggtcaaaaaatcagtcaaatgcctttctcccacagcagtgtcactgggactgccagtatgggtcatcagtatgcttggctatttgtttcttttgtttcttagctttccaaatcatccccacatcagtactgacacaactgccactttaaagcataaacatatacttccttgaaacgtgataagtcttatctctcctttctgaccataaaagatgcagcttacacacaccacttattactgttcttcagaatagatgccacagtcattgcctttaccaatgcttgctgctttcaggaagtgggagtcagtgttaaatgctgctgttggtaaatcatactgttggactctgatgtggccattctgtgtgtcagtgcagaaaatgtcatccttgctaggcacagtggcactcgcctgtaatccctgctcctcaggaggctcaggcaggaggattgcatgaggccaagtgtttgagaccagcctgggcaacatagcaacaccctgcctctaaaaaaattaacaaaaagaaaatgtaaaaaaaaaatgaaaataaaatgtcatcctttcatatcaaagcattcagaagagcatcattttagaacaaacatttcccttatttccttggtcacttatggttggaggtgaaaatcttctcattttcagtacacaataagaaacacttccaaagcatctggtaaagaaaaaaaaaaagaaaaagaaaaagaaaggaacacaatcctagcaattcatcaaatagaattattgaccccgtgtttccatgcaaggaccttctatcatgtgtttccttaatatcccattaaagcactctaccacccttgttctcagcttttttcgctagaaacatacctggagtaactcccattagtattaacaacttatctcaagcagtgattaagagacagaaaagggggaaagcatgttctagaggatagccaactataagtccctcatgcccatccccccctcacaaacacagccagaacaatgaataaataactgcattttaatgaaaaaaaactgaagaagagcagcagagtgtatccgtggagtaacagaaaccctggtgagcacagaaactcaggatggtcacatcgagaacagaaggaaacaccaggcctccaccatcgcatcccccagctggatcagctgggaaccaggaagaactcccttggcaaggaattaagcagaggatcccagcaacccccatcaacactttggacacctacagacctcacaatgggaaaccctgcagccctcacaagcatgaagcccagctgaaggaactgcctggagtccacagagctatgctccccccagtaaaggagtcaacgctatgctccaacctctgtggcctgtgcaactactgcactacaccatgttggaattggaactatggctagagtttttcttgctctgggagcaagtagtcacagcaccccttcatccccaatgctaccccaacactgtggcctaacatccacaggctgagatgcaagcagctgttacaactttcccagtggagccaaatagaggtggagctactccacccagcccgccgcccgccgcatccccctcagccagagctaaagccatatacggcctcctaggaaaacagtatcttggctgctcagagcagtcatgcatccctaagttcagtcatgtactagcctaagttgagccagcacccagcatcccaggaaatgatgcttttgctgcccaaagtaatcatgcactctagtacctaagctaaagcagcaccctctatcccagagaaaaagtgccagagccacccagaacagccatgtccccagggcctgagctgaagcagcacatagtccctaggtgccctggctgaactgagcagctgggcatccagaactatgccgatgtagtacccacaacccagggaaacagagcagtggctgagctgagacacctcatcctacaggtcaaacaacttcctactctcctttcctgaagctagactacccccctagtgtctgagcagctgagaaacacctcttcctaggaagtgcagtcattgctatgctatttattgcccccaccccagggcccaaatgacagcagtgctccaccagtctggattacttattgctgctgcacctggctgcacaaagtctgggattctaccaagccccaccagcacagggtctgcagtcactactacatgctgcctcatcccctgggacctaggttgccactaagccctattgactcaggttcctagatagcaacaatagcctactccccagccccaaacgtccaggggcaacccttcttctctggagtcaggccagagctgtgccctgcccgccaggggcagaatcatagctacaactcagccacctgaacccaagctgctaaggggtacccaaagtcacagaccctggctctgtggacaacctacactcaaaactaccacaggaaaaaaacaagcaccccaagacccaggtgccacaatgggttcacaagacccttagcctaggaccctggccccacatccactctaagcacctgtaccaggaacccggtgctgcagtaggccttcttgaaggccatgtcagatttgacacaaagagggatctccctaggctatatcttcccattgtggagaaaataagaataaggaagacactaaaagcccttaacactgaatattagcaaactatgccaccaccaccaccacttccacaaacttctgtggactacgtaactgaggcacccacagttactgctcgccctgaaagcacctgaagatgctgcatggaaactataccactatacctattgaaaaagtcaccacacccttcccagctggcacactaaaacccaactgcaaatgaaagactttttctatggaaaccagaaagattggaagaaagaatagttctaccaggtgcacagattcatgcaggcttacaagaaacacaaaaaagcaagcaaatataacaccgccaaaggaacataatgggtctctagtaacagacccaaatgaaaagaaaatcaatgacctgctggaaaataaatgcaaagtaattatctgaaggaaattcaatgagatataataaaaaatatatacagacaagtcaacagaatcaggaaaacaatttatgatataaatgagaaattcagcagagttaggaatcataaaaaaaaacagaaatcctacagttgaagaattcaataaatgaaataaaaatgcaatagagagcttcaataacagactttgtcaggccgaagactttctgaacttgaagataggtcatttgaaattacccactctgaaggggaaaaaaagaaataacaatgaaaaagaatgaagaaggcctgtaagacttacgagccatcattaagtcaacaaatttttttattatactttaacttctggggtacatgtgcacaacgtgcaggtttgttacataggtatacatgtgccatgttggtttcctgcacccatcaactcgtcatttacattgggtatttttcctaatgctattcctcccccagccccccaccccacaaccccccgacaggccccagtgtgtgatgttcccctccctgtgtccgtgtgttctcattgttcaactcccacttatgagtgagaacacacggtgtttggttttctgtccttgtgctagtttgctgagaatgatggtttccagcttaatccatgtccatgcaaaggacatgaactcatccatttttatggctgcatagtattccatggtgtatatgtgccacattttctttatccagtctattattgatggacatttgggttggttccaagtctttgctgctgtgaatagtgtcgcgataaacatacatgtgcatgtgtctttatagtagaataatctataatcctttgggtatatacccagtaatgggatggctgggtcaaatggtatttctagttctagatccttgaggaatctccacactgtcttccacaatggttgaactaatttacactcccaccaacagtgtaaaagtgttcctatttctccacatcctctccagcatctgttgtttcctgactttttatgatcaccattctaactgccatgaggtgatatctcattgtggttttgatttgcacttctctaatgaccagtcatggtgagcattttttcatatgtctattggctgtaataaataccttcttttgagaagtgtctgttcatatcctttgcccactttttgatggggttgtttttttcttggaaatttgtttaagttctttgtagattctggatattagccctttgtcagatgggtagattgtaaaaaattttttccattctgtaggttgcttgttcactctgatggtagtttcttttgctgtgtagaagctctttagtttaattagatcccatttgtcaattttgacttttgttgccattgcttttggtgttttagtcatgaagtccttgcccatgcctatgtcctgaatggtattgtctaggttttcttctagggtttttctggttttaggtctaacatgtaagtctttaatccatcttgaattaatttttgtataaggtgtaaggaagggatccagtttcagctttctacttatggctagccagttttcccagcaccatttaataaatagggaatcctttccctgttgcttgtttttgtcaggtttgtcaaagatcagatggttgtagatgtgtggtattatttctgaggcctctgttttgttccattggtctatatatctgttttggtaccagtatcatgctgttttggttactatagcattgtagtatagtttgcagtcaggtagcgtgatgcctccagctttgttgtttttgcttaggattgtcttggcactgagggctcttttttggttccatatgaactttaaagtagttttttccaattttgtgaagaaagtcagtggtagctttatggggatagcattgagtctataaattactttgggcagtatggccattttcatgatattgattcttcctatccatgagcatggaatgttcttccatttgtttgtgttctcttttatttggttgagcagtggtttatagttctctttgaagaggtccttcacatcccttgtaagttggattcctaggtattttattctatttgtatcaattgtgaatgggagttcactcgtgatttggctctctgtttgtgtgttattggtgtatacgaatgcttgtgatttttgcacattgattttgtatcctgagactgctgaagttgcttatcagcttaaggaggttttgggctgagacagtggggttttctaaatatacaatcatgtcatcttcaaacagagacaatttgacttcctcttttcctatttgaataccctttattgctttctcttgcctgattgccctggccagaacttccaatactatgttgaataggaatggtgagagagggcatccttgtcttgcaccggttttcaaagggaatgcttccagtttttgcccactcagtatgatattggctgtgggtttgtcataaatagctcctattattttgagatacattccatcaatacctagtttattgagagtttttagcatgaagggctgttgagttttgtcgaaggccttttctgcatgtattgagataatcatgtggtttttgtcgttggttctgtttatgtgatggattacgtctattgatttgcatatgttgaaccagccttgcatcccagggatgaagcccacttgatcgtggtggataagcttttagatgtgctgctggattcggcttgccagtattttattgaggatttttgcatcaatgttcatcaggatattggcctaaaattctctttttttgttgtgtctctgccaggctttggtatcaggatgatgctggcctcataaaatgagttagggaggattacctctttttctgttccttggaatagtttcagaaggaatggtaccagctcctctttgtacttctcatagaattcggctgtgagtccttctggtcctggactttttttggttggtaggctattaattattgccccaatttcaaagtctgttactggtctattcagagattcgacttcttcctggtttagtcttgggagggtgtatgtgtccaggaatttatccatttcttctacattttctagtttatttgcatagaggtatttatagtattctctgatggtagtttgtatttctgtgggatcagtggtgatatcccctttatcattttttattgcatctgtttgattcttctctcttttcttctttgttagtcttgctaagagtctatctattttgttgaccttttcaaaaaaccagctcctggattcactgatttttttgaagggttttttgtgtctctatctccatcagttctgctctgatcttagttatttcttgccttcttctagcttttgaatttatttcctcttactcctctagttctttaaactgtgatgttaggatgtcgattttagatctttcctgctttttcttgtgggcatttagtgctataaatttccctctacacattgctttaaacgtgtcccaaagattctggtatgtcgtgtctttgttctcattggtttcaaagaacatctttatttctgccttcatttcattatttacccagtagtcattcaggagcaggttgttcagtttccatgtagttgtgtggttttgagtaagtttcttaatcctgagttctaatttgattgcactgtgatctgagagacagtttgttgtgatttctgttcttttgcatttgctgaggagtgttttacttccaattatgtggtcaattttagaatcagtgcgatgtgttgctgagaagaatgtacattctgttgatttggggtggagagttctgtagatgtctattaggtctgcttggtccaaagctgagttcaagtcctggatatccttgttacttttctgtcttgttgatctgtctaatattgacagtggggtgttaaagtctcccattattattgtgtgggagtctaagtctctttgtaggtctctaagagcttgctttatgaatctgggggctcctgtattgggtgcatatatatttaggatagttagctcttcttgttgaattgatccctttaccattaagtaatggccttctttgtctcttttgatccttgttggttatcagagactaggattgcaacccctgctgttttttgctttccatttgcttgttagatcttcctccaaatgtttattttgagcctatttgtgtctttgcatgtgagatgggtctcctgaatacagcacaccgatgggtcttgactgtccaatttgccagtctgtatcttttaattggggcatttagcccatttatatttaaggttaatattgttatgtgtgaatttgatcctgtcattatgatgctagctggttattttgcccattagttgatgcagtttcctcatagcatcaatgatctttacaatttggcatatttttgcagtggcaggtaccaattattcctttccatgtttagtgcttccttcaggagttcttgtaaggcaggcctggtgatgacaaggctcccagcatttgcttgtctgtaaaggattttatttctccttcatttatgaagcttagtttggctggatatgaaattctgggttgaaaattcttttctttaagaatgttgattattggcccccactgtctcctggcttgtagggtttctgctgagagatccactgttattttgatgggcttccctttgtgggtaatccgacctttctctctggctgcctttaacattttttcctccatttcaaccttggtgaatctgacgattatgtgccttggggttgctcttctggaggaatatccttgtggtgttctctgtatttcctgaatttgaatcaacaaatatttttatcatcagagtccagaagaagaagagaagggaaagaggataggaaatttatttaatgaaatactagctgaaaaacttcccaaatctgttgagagatatagacatccagatccaggaagttcaaaggtctccaaatgtattcaacccaaaagatccttcccaatttgtcaaaagttaaagacaaagaattataataacagcaaaagaaaagcatcaagtcacatacaaggaagtccacattagactagcagtagatttatctgcagaaaccttaaggccagaagggaagggaatgatgtatgtaaagtgctgaaagaaaaaaaaaatgccaaccagaaatactatatgcagcaaagctatccttcaggaatgagggagaaataaagcctttcccagacagacaaaagctgaactccagcttcttagccttcttttctcttttcaccagagcaacccaacccctagacttcctgtattaagaatataaggtggccaggcatggtggctcatgcctatgattccagcactctgggaggcccaggtggcaggatcgcttgagcccaggagttcaagaccagcctgagcaacatagcaagatgccatctctaaaaataaaaataaaaattattcaggtatggtggcacatgcatgtggtcccagctactcaggaggccaaggcaggaggatcactggagcccaggaggtcaaggctgcagtgagctatgatcatgccactgcactccagcctgggtaacagagtgagaccttgtgtcaaaagaaaaaatacatttttaattaaattttatttaaaaagaaaaagaacataaggtggtagtgacagcaacgacagaataccaaggttagtctccatgtccactgtattctttgcacaacccctactatcttgtatttttgtgagatgatcaggtgaccaagtttgttttcttttctactttattctgtagttatcatgtgatgtaaaacttgatcctcgtccagaataccatcggtgtatactaacttggcatcaccaagaaccactaccttgggcacagagtacaggttagtcattcacatctacagatattcctagacacctatcctgttaaaacacaaacttatatataatcttccttggttatgactgattttgtaattattatacatttttctttttgaaaagttagatgagttaagttattcctaaacagtatagcaaaagttaaaaaataactattagaagtttacttattttattgagccatattttctagataaacatttagaatgtccacatatcattgactaatgtcctgtaataaatctggaattacagaagatttgatatgtttgttcaaccaataagttctgagtataactttgtaggaaaaggaggagattctagctataccatcttgaaatgtgagatgaaagcccaatttataatttgattctctgtagcctctaccatacgctagttattggtaaatttgaagggcagagaaatcaatattgataatgcagagttctacagtaaccttcactagactttaaactgttattcccaacttccctactcatattttgcctaatttttgatgtgactccagaaaagttgtagtactctttaaacaaagatcctaccaagtgaaaacgtcaactaacagcgactaagttcatgggctttgccatcagagagaactgcattcaaactggccaccaacctacttagcaggaccctaggcaagttacctaaaaattttttgagtcttgtgagaatcaaataaggtgtttaagtaaagtgcctagtactttggcactcagtaaagaaatggtagctgctaccattattgtcattattattttaatactttttttaaagcctcccttttcagacacgcataacatttcagcctgaattgagaaattctatggcattttgcataatgctataaaatcctggttttactctttcaagcaagaatttctaatgtttatttttaaagtttgaatgagaaggtggtaggatataatagcatggccacctgaaaaaggtactggaaagtttgatcatcccttctcctcttgaagacccgcatttctgtctgtttacattttgaaaaggtctacaagggcccaactgtatacgccatgatgcttatgctgctgtaataagagtatttctttctaggtaatcaaatgagcagccgtctgatgagcatgcgcagtgccaatggattgttgatgctacctccaaagacagaacagtacgtggagctccacaaaggcgaggtggtggatgtcatggtcattggacggctatgatggtcaccagcaggagaaagctttgatgcatgtccacatatcattgactgtatcctgtaatatgcaacggcacagctagttttcccgatttggataaaagttgatctgtatagtcaacatcttgaactatatttcaaatgaatttaaatatcttttaaagaaaaaaacacctaaaaataaatcttaacagaaaattctgttctgattatatcaaggcaaatttttcctttcttgcaaattgctttgtgtgttcaatgctaggtctgatagcgatagcttttagtagacagcggtaggtgcctgcagaacttgtgtttttctcatctttaaaatacaactacttatgctcttaaatcaaggctgtctgcttatttatactagcgtaggcaacacttggatttcccttcttagtatgcttcataactgctttacagagagcttttgcttgttctttctcatgtatctcgtgtttatgtgcacagtgccaaaagaagactgactgggtggaggctctgccttgcctcaagaaccatcccctgcagagcatccagggaggtttctcgccccaatagcctcacggcacagtactcttgggcagtaactggacaccttttatttgaagaaacaaactgaagaaaaaatgcttccttaagtgctgacagcctttttaaccaatacatttaaaattgtacagaacaaaaaaataaaatcaaagactgatcttgtacagatattagtgttaccagcattcatgtggaaatcaagagcaaagacaaaataatgttaaacaattctgtaccataacattttctgtaatgatactgaaacttaatgaataaaaaaattccttgatcattatttaaaaatgtaa

SEQ ID NO: 78 - DNA, 674402 bp, Homo sapiens; identical to SEQ ID NO: 77

SEQ ID NO: 79 - DNA, 1383148 bp, Homo sapiens
gaagacctagaaggctttaagaaagacagggtaatattttgctggtgtagagggcctgctcttcggagacaaatacttgcttttcattttgatcagccgtctgcacttaaaagcctcctagccagggacatgttaattaaacagtctggggctcagtgctgccatccgtaaattggaggattagagaaataatatacacaagtacctggtacataccaaatatgatagaagatatcttcaacctttagctataagaagaatggaaaatgaaaaagagacaggtggagagagggagggagatgagagctgcgtggagctggtatgctggttaggaggtaggaaataatgaggcctcgaccatctaagatacagaagtctccctgctgaatcgaaaggaagtgctacaatattctttcaaattcatcgcagttgagagaaaactggagcagagtgtgatatcaagaaagggcttcaccaggatgatcaatgcaaatggatatggagctttcttggaatgaaacattatcccgtaacaccaggtaattttctttattaaaaaatacacattaaagtcttagaatagtttgatatttaccgacaagttgcgaagattttacagagccgtatataccaccctattgctaatattttacactactatagtacatttgtcacaatgaggaataaacgttgtggcacattactattaactaaactccatactttatttaactttattacttttcccctaacctcctgttccaggatcccctctaacacatgacatttagtcattatttctccttagccttctctgaactgtgacaatttttcagactttcttttcgacaaccttggcagttttgagaagtactggtccctgattttgtaggatgtgactcaagtcgattttgtctgatgtttttctcataattagactggggttatgggctttggggaggaaaacttcagaagggatatactattcaattcatatcctaacaagggtctatgctatcaacgtgacttatcactgatgctgttaacctagctcacttggctaagacagtgtttcaggtgtctccactataaaacgctcttccccctgcttcgcacaccatactctctggcagcaatagttggcaccgcctacccttacgtggtggggaattattctctatctccttgagacagggcaagtatcaacataaattatttaaaattcttctattcggatatctgtctcttcctcttctcccaccccctgttgactttattcaatcacatatttattcaatcacttagctcctgcatacttttagcctacacctatcatttttgttttgtaagcatttccttactttctgataccatcataagctccaggatgatcttgtatattccctgccttggccctagaatcagcaatttccccgaggactctggtttctttcattggagaatggtttttgaaaccaagatcttggtgctgggtgtgctggtcactacaggggattcatcgcttctaggccctctcagtggacagagctaggaaatctatatgtgcatactaacccatgtatgtatacatatctataattatttcaatagccatccatctgtgtccatattaaatatttaagcatgagttcacaatgatgtttcctactctagtactgtaccacatggatcattctagtcttcctcctttgcttgtctgtaacctcccatttgaaaactgagaaaattggatctaactcttattggttcatttacttactttttccatccaggtatacatacatgaagagtggcttcaggactggtaagttatgttcctttgaaaaatagctttaccaactagaggacagtgctcatgtgcagttcctttgcccttttatcttctactttccaataatttccaaagttacttaggtcaacagtctttaacccaccctcttcagtgaagttatgttatatacttagcatacagttacatctttttgtcgaagtgtgcatttcatcccaggatctcttaatctactagttattttaaatttgcctatgttaaatttattctctgctctgtaaagttctatgaattttgacaaatacacagtgtcatatattcatcactatggtactgtgtggaatactctcgccaccctaaaagaatctcctgtgcttcacctagtcaactgtctccctccccaaaccccttcaaatctctgatcagttttctgtccatgtatttctgccttttccagaatgtcgtgtgaataagatcatagattatgttgccttttcagataggctttttttcatttagtaatatgcatttaagattcatccacattgtagcatggattaatagctcattctactttattgctaagtaatattatctgtggatgtgtccgtttgtttatccattcaccttctggagaactcggttgctttcagttttgggtgattataaataaaacttctagaaacattcaggtgcaggtttttgtgtggacataaattcaagtcaattgggtaaatacctaaaattgcaacttatgggggatatggtaagtctaaactgtctttcgaagtggctataccattttgcattctgaccagcagtgtgcttcaccagcagtatggatattgtctttttatttttttaagatttcagtcattctaataggcacgtaatggtatcttcttgttttaatttgcagttctctaatgacaaataatgctgagtatctctttatatacttatttgctacctgtatatcttctttggtggggagtctgttcagttattttgcccatttttaactgggttatttattttcttattgttgatttgtaagaggttttctaaagaaatatttcagatacatatcgtttattagatatggttgttgaaaatattttctcctagtctgtggcttatcttttcattttcttaacagtgtccttcacagaacaaaggtttttaattttttattgtatttctatcctctttttgtccatggttatatcctctactatacagagctgttccacttactgttagagcaaatcgtattaatttctgttgccctaaataattgtccattggccgagagctgtggctcatgcctgtagtcccagctacttgtgagtctgaggcgggagaatcgcttgaacccaggaggcagagattgacgtgagccgagatcgtgccactgcactccaccctggatgacagagtgagactccatctcaaaaaaataataaataataaataaataattatccattatattgtattgaaaagagctgctatatatggcatgataccactcattatgttagttttccccgttctccataaaatgaccactgtgtctgtcagagttgtcacacagaagtctctaaccatcttaacacctgagcatgcccaggactggaggggaactattgcgttctgtatagagtacaacaatcatgggcgttggactcagagacctcggttcagattttgctcttaacatttcctggttgtgtgaacgtagaaaagtaacttaagttttctgaactttggccttctcacctataaaatgaagataatatcgtccacgtgtcttaggtgctattagaaggacacatacgaagtgtttagcacagggcctgacggagtgtagcactcagtaaatgttagtgcttacttgcttttcccccttgtgctccacattttctttcagcctcctgatttttcccagtggaactctttaccttgcatccatcatttctattgcaatgcatttctatgccttttcgaggagcttttctattccatctacactgaaaatggctcatcctattgatacaatttccctgctcccagccaatggctgctgcagcacttcctgatatctagatcacaaagtccctgaacaggttagggtagcacatgttaaaaaaacaatattcctgcaagttcacctttctcttacttctcatttccaacctaagatcttttcaatgagcttactctgattgaatataaaaacaatttttaaataattcaacctaaaataatagaagtattttttgcttttattatttgtaattaagttataataattgtacacatttatggagcacagtgtgatattctgatacatgtatgcaatgtgtaatgatcaaatcagagtaattagcgtctccatcacttcaaacatttgccatttctttgagttgggaacattcaaaatctgtttttctaggcatttgaaaacatacaagaaatgttgttaattatagtcacctacagtggtatagaatgttaaaatgtattcctttcatctagctgtgcgttgtgttgttaaccaacctttggctgtgcttccccccacccctacctgcctctggaatcactattccactctctacttctgtgagataaacttggaaagaaataatactattaggatgataatttcccacaaattcatctataaatttattgcaattctaattaaaaatcccatatgatttattatggacctgtcatactaaaacttgtttgggagagaatatgctggagaattgccaagaaatgtatcagaacattctataaagccacaataactaaggcaatctgatattgacaatgtgtattttatcaatggaaaataataacataaacatatatgtatttatgtggtttgttcatatatatgtattgtgtatgcatagttgtgtgtatatatagtatttatatgcatatatttaagcataacaattcaaatcatcatggaaaggatggaccatagcaaagggtctttattacacaatagttgtgagcactggccctggcaccagactgcttgctttgaatctcgactctgtttccgggatttgaatctgtcagagctatgtgaccttaggcaggttgtttaatttcttggagcatggcctcagctttcttttgtgctgaataagaaaataatagtacctaactccaaaagtacttagaagggttaaatgaattaatgtaggtaaggagcatagaataggtgctggcactaagcaccagcgaatgtgaaccattcttattattatcatccataatatagaacgtaagcaattgtctgttcgctttgaaaagtaacccttggcagggcgcgatggctcatgcctgtaatcccagcactttgggaggctgaggtgggtgggtcgcttgaggtcaagagttcaagaccaacatggccaacatgatgaaactgcatctctactaaaaatatagaaaactattagctgggcatggtggcagatgcctatagtcccagctactccggaagcacaaaaattgcttgaacccggaaggcggaagtcacagtgagcaagatagagccactgcctcccagggcgagagaggaagactccatatccaaaaaaaaaaaaaaaggaaacctttagtgactagtttagagccctacactgacaggtgcctatccagttgctgatttcttgtgatgtggatttatttttacttcataaaataaagaggcaaccttacactttgttattaaaatagtaagtggtaaggaaccctttaagggatatggttttaacatattattcaaaataggaattgcaaactcaattgcttagagaggtcagcaagtaaatcaatgtactagactgggtagagcgtgtggtgaaatgaaggccttctagacgcttaagaagacaaccagttttcaacaccacccaattattgccaggcagaaacatgcgtgcacattttttaagatttttattttcatgcaatattttctggcttctaaatgttgacaacaaattcaaagtttgaagcattgtgtggatcaaacaaaatagatgtctagagatcagagttggttcatattgtttgttgcaatctgagacttagaacctcctttaggttacactacccagtctttctcccaacctgtgtaccccaattgtaccttgcacagtgctgcccaggtgataaggaatcaatgcttgttttttgttgaattaacttgattttaattctgaatctttctgattccaatcaatgctttgaattaataatactagctcctggccaggcacggcggctcacgcttgtaatcccagcactttaggaggtttaggtgggtggatagcttgagcccagaatttgagaccagccttggcaacacagagagaccccatctctacaaaacaaaacaaaacaaaacaccacaaaaaaacattagccaggcatggtggtgaagtgctgtagtcccagctacttgagacgctgaggtgggagaatcacatgagcccgggaaggttgaggtagcagtgagctgtgattgcagccactgcacttcagttggtgccacagagtgatacaccatcttagtaataataataatggtaatagtaataaaagtgatagctccctctgttagccatttattttaaatatcaggtgctggtagggtctttacacatatccctctgatcattacaatactccgtaaaggttgcttttctcactttatagatgggaaaactaagaggttcagttacctttctaaggtccaaggctagtagaattagtgatatgacattgtctaggtctgcctttttgagggagtgagatgtcaaaagtagtagcaagaggtccagatccctctagggtgtagtgtttcctggcatcagctaactgggaatactgatcacgtcttgtcctggaaacacatttcattggatgaccttgtcaggcttacaatgcaaaaaaaaaaaaaaaaaaaaaaaattacaggataaaagatgaaagatgtcttccacttacaaatggcaagcgatagctatccaaaggttcatttgtaaatcagttgtttgaaactcggaattcattttcctgcagaaacagttacaaatggtggttatgtttcccctgaggctcatccacaaaagaccatttagccttaatgtatctgaaatagtgtacatttgctgtgaaaatgtgtagaaaatagaactcttgtaattctagtaattaaataaaagaaaaagtaaaattgaatgagaactttaaactgcatcttgaatgctgcttcgaaagaaaagcagatttacccagaagaggatgcagaactttgaaaataattttgtggggattttaaagggggcttctgaatactttcacagcacttgagaagttaatgaaatcatatcattgaaatatcgcatttcatttcgtgatttctagatttttaacataatctttccatgattaatgctatttctagtgttctctttagaacaagaagaagaagggaaaaaagggtggaaaaggaaaagacaaatgaaaatgggcttcctaatgatgcagaagttgacagagatagcatgtgaaagaaaattaaagatcatgtttgtttttcgataggcatgcaagaagcaaaattagccatgaattatgaacagtggaaggaggaaaacatagattctgatttcacttgagagagacaaaacaatgctggtggcagagatcttttctctgagaaattccagaaactgttactgttttattccatcatcttagggcatcatacttcatggcaaatgtaggatgggtacaggattgagatcaagagtgcaaaagttgctcaaatggactaaatgttgagaatactaagtacttattaaacaagagaggatttgttctcaaacaaaagtaattatcattttttattgtctaggttttatcattcatcttgtttaaccttcagccaggagaatgaaagacagaagtttttaaaaaatatatatatattgtgggcggggtgtggtggctcatgcctgtaatcccagcattttgggaggtggaggcaggcagataaccatacaggagtttcagaccaggttggccaacatggcaaaaccccgtgtctactaaaaatacaaaaattagctgggagtggtggtgcatgcctgtaatcctagctagtcaggaggctgaggcaggagaatgccttgaacccaggaggccaaggttgcagtgagctgagattgcaccactgcactccagcctgggtgacagagtgagactccatctcaaaaaaaacaaaaataccaaatatatgtatattgaatggccaaatggttgaacaggaaattgaggaagaatgaacaacctcccagacacttccacagtgagtttgcaaggagcctaaaagctagctgcacagagcagaggcccttcctgccaaatgtaaccttctttagaaatagagaagagaaagacagttgggggacaggggttattatggatacaggacaaaaacaaaccagggtaaagaaaccaaaaaccaacaaggccaaaccaatggacaccttgaggtgatgtgggcagacacagagtgtttccctttgttgttctttggagagtaagataggcttccaccacggaccctcttgtcaataaatcttcctgggttaagtggttagttagactaaattgctcttccaccaatttgagctgacagcagcacagaaccgtcaaaaccattgctgtgttgtctccatagccaaagagtgttgttgatttatttctgttagaggaaaattttaacttgcctacctttattttttttaatcatttgaatttaagacactagttcccagtaggattcactatgacaattttcagtgatgagaaaaagcatcaagggtttctggtctctgaagaattgtgttctttttggccaataaaattaaaatgaaatagatttaaattgtattaattcctaatttaaagctgaagtttcaagtcaccttccattactattgtataggatttctacataaacctattgggacctgagacaggctaagccttactaaatttcctggctacagggatatttcttttggggattggagatgagaaggggtaatatcgacaatctcattttctccttaatttttccttgattgaactggtgtccatttgcttaacttattcactgtgtgttatagaaatttacaagttactttgcaagtgtagctatattcatgtatgtgctatcttttctttcttcaattaaattgtgagctcttttaagtaaggaattatattttatcttctcccacaatgaccaaagccagagtatcttacttaagacacttgaaagtggaatacaaaaagtattttcatgcagtccatactgccttgtttgctaattgctgtacacatgcagacatcatctcaccaactatgccctaagcacctcattggtggagtcttgttttgaggtagtggttgtaacagtttgggtcttttattagtgcattgtagggacagagtagcctctcaacaaatagttgtttgttaaatagtcaagtttggagggcagtagatgagacaaagtagaaaatgagagcttttgcattaaactatgacaactaaaatctatatttaaagtttacaacctaactgtatgttctttttagtacataccacatcattaaaacttgataaataatgtttcctcaatactgttacttaataagtaataaaaatatgatgctggcaataaaagctgttatattgttactgccttacctcctggttggtgagcaaatgctagaaagaaaaaatgggaaatagtttaaatttgagagttttggatcattttcttggcaaagtcaagagaccatttgcttcttttaagcagtctaaaaggtgtcaaaggattagaagcaaaggaaatatcagcattgctgtgctgttagacagattcctagagaatcaaatagggatggtaacaagattgagcaacccatctccttagaattttgcttccctttacaccgacaacctccctattttatttttaattacccatagaaataaacaggaatgctaaaatattttttgaagataaattctataatcatttcaagtttgattgttgataaatatgatatggatgaatataaagagtagattttcaatatgaaaaaagagtctcctaaaatgacgtgggttgtaaattggagatgaatttcttattagttttagtgccttttgtgtctcctattgtcaacttaaatggtctcacacaacacatctgttgctaggctcatgagatggagcagagttcaacaggtacatttcaaggccaggaaggctgataaactgaaggttcagtaggtaagagaagcactagaaacataatgatcagtgaaatttagtactatcaagaggctagaaatccggttagaaaacaaaccacaggattggtaggatctgaaagttgtcacagcttcaacagtcagtattgccaaagaaaataaaatggggcactttttaaaagcagtaaacttcgatttcactcaggaataactattgcaatgtgggagagacctcagcataacagctcagtccaacgaaaggcaggagactgtttaaatgctggggtgtacccaaagaaaggcattaagggagagattggtccatgtgattaggctatctgggtttgctaactagtgttcacctagaggagcaaacttctcatatctttttgacagaaattagtggtgcaagttggagcaaggcatccactgaagttaggtccttactgtcctacagggactgggaatgagaactattgccttgaatgtttgtatttcaaggagatggctctcatgtccttgaggagccacttctggatggtaaaagatttatttcaatgggggcagagaaaggatttataattgcaagctttctaaaataagtgctttaagagggattcaagggcctattggcctatcaccaggttttggctggaacaaacagtaaattctcctggcagcattgagctttctcagaaagtcattttaaggggggttagtgcgagaaagactgaaaaagaagtagtcccagaactgttctcaccttcgatgcaggctgcgtctcagcctaatatttgtcctgatattattatctcaggggactcacagtcaggaagagttggtaaagaggttgtcagactttaatctcccccaacttctagtaacttaccagaagatgccacaaagtttagtggtgatggagacccctctagctagaagaaacttttggtatttgtttttattctatttgtgatgtgttctagcattgtgaaatgaggcaaaaagaaatgctgaagctggttcacagaagtaagttggtgtaaaatcctatgtggtccaggtttatctcaacaatacaatctcctcatgccgttctaccttagccaatctcctcccatcaccatagcaaccacatcttataatatgtgattccaacttagagtgcctcatcactgccctttgtacatgcagattgggaaagatggaagagactgttcttgggaatagcacacagcaatctgggccaaatctgggtggtgtgtgccccactatttgccaagcttattatcattttttttctcctttggccttattcaactagaagtcctctgcatctactagaattcactacatatatagccccaatcttctttcttttatctctggcagtgaacaatagaaggcatttaagagcatgaaaaaataaataataagtgcagtatgaggtgtatggtagccattgctattaaaattactcattcacttttctatgatgaatgaaactctagtgataaataataatggtgcccctgaaaaaattaggtttgcaattaggacaatttctgccttgtagacaaactgcctaatattatgcttcaagacagttatttaccatagttataacccaatgtgtcctgctgaaatggcttgtttttcctacaatgttaaagatttaattttttgaagatcagtttgtttgaaacagcagctgtacttttaggaacataacctgaagaaatgtagatgtagatgtaggttaaagtgagttcatcacaggcaatcgaagatgtagtttaaagatgtagaattgttgatagtagtaaaaattgtgaacagtcccagatattgaaccttagaggactcatgaagttacataaggtaaacacgtgcaatagatacaatgtaacctttaaattgatggtaactgtataatatttttgaaatggaaagatttttatgatacatttttagtgaaagaagtagcttgcaagtaatgtaaacactgacatttagttattaaaagatacatatacatatttgtatatatttatacttacatacatacatacatacatacacacacttatatacatttggctaaacaaaagcttaaaagaatgatttgtaattttgtgaatgcttttgttatttttcgttgttgtttttctgagatagagtctctctctgtcgcccaggctggagtgcagtggcacaatctcggctcactgcaacctccgcctcccaggttcaagctattctcccgcctcagcctcccgagtagctgggattacaggcgtgcaccaccaggcccggctaatattttatatcttcagtagagatagtttgcaccatgttagacagtctggtctcaaactccttacctagtgatccacccgccttggcctcccaaagtgctgggactgtaggcatgagccattgcgcccagccgcttttgctatttgataattattttcctaataaaatcctatactaatggtgtaacaaccaaaataaaaaagaatgaggaacgtaaaattgcagtttgcttttcttattcattatgtcaacaaaaccttagccaaccacactggcccttcttctttttcctggccaagtcaaccctattcctatgaatgataactggagaaaatgtgcccagtgtggggaacaaggatatgttggtgtatacctaccatggtatctttctcaggggactgagtaaatacagggctctgtgcaacacaggaagaattcttaaggggcacctcaaattccaaaattcagatcctttaaagagagagggaaaatcagtactgccctctgacttggagtgagaatataccctgctgtgaagggaagaaggtcatcctaaggtgggaaaaactaaaggtaagtactgtacatatgtctgggacacaactttgaccttgggggagaaacacacccattactgagtagctttgtcctccacttataaggcattggatagatgttcaaaatggggagctgtacctatgaaacttttgaaagtcatggtaggggctatattccagaagggctgcaaaccctaagagatgggtcatctgcattctgagccttgacagtgaactgaaagagtggtcaccctctgaggaacctggaggccttgccatgcatggcgcaggggcttctgtgcatcagctatttgttcttgaagcaatctggtcagcttgaagaatctgaatatcatagagggagaaaggcttctatagagcattaaagcttgtgacctgaattcccaatgtatgcatttgttggtttatcctgaagaagagaacttaaataagatcatccgcacggcacagtttacacacaagcatgttatttttctgttttctctgttgcactcccagatttttaaaaaacacttaccatgatatccttcaggactcacctttcctggcacagaggtttttataataaatagtaatggaatgaatgagtgagggtgctatataatatttaccgatatcctacttttatatatcaggcctcatattatggtgcagggcagcacaatttatacccagttgttattgccatttatattcaaaagtatcaagctttgtcattttgcaaaaatgcttttcagtcttggaatttttatttatttagactggttttctctctctctctgcccctctctctctgtctctgttcttctcttttctcccaggtctaatgtatcagaatcacctgggatgattgttaaaaatgcagaattcagggatccagtgcccagtcataatctctagggctgggatctgaatattaacattttttaaagactgcagctcattctcatggacactaaattttgagaaccatttgtagttaatctatttaaagaatcacagttttatacatcgtccgtctgaaaatgcaaggtatcacctagaaacttttaagacaacttttcctctcctaggaactgtaaaataacaaagtagacaagtggagagtaagggtgatagaggtgggtggatcaataggaactctctttcctgtgagggtaacttgatagtgactaggcggtgcagttggagtgaattgattttgttcaaacaagttttcctgtttctcagagttcacagtgaacatttttttgcaggcttcttgcagtgtgctgtttcacaaaccatcagaggcatttagaagggccagggtttttcttctaaggcttaagaactttaaatctcttgggtggaagtagttttcagtgacttgtttgttcttgtgatataagacatagtaccactaaccccttgaatctatcattcctacttattgctttaaagccaggatagtatcaagttcttgatgtactttactaatcatggctttcattttctaatgtgtatttaatggatatctattcatttatcattcttaagtacagaacactaaagaaagcatactgtaatcagagatgttatcaggctcaattattttagattaactgggtattgttatgacaatactctgtgatatccctatcttcaagtacaaagtaggcaaggaaaaaaatgcacatcaaataaaaagtagttggcaaaactaccttttgatccattttctctctattagaaatatgaatggctctcaaatgttttacaaagattgtacattggacaccaatgaagctgttcaacactaaggcccaaaaaagaaacaaaaaaatatggtggctctttttgagaaacaatgaatttcatgtctttctagtaaaacacactataaaatagttcttcttgtgtttacatttatataatcattgaatcatatgccacagtcctggaaagttcaaacaggaaatagtgcgtatgtgtgagtggggagctactctgtgggactggtgatggcttggtggatattatttttcttttttaatcaaagtttagcaatcatacagaaatatgtaggcaattaccaaactcagtgaaatgtacacagatacccatgcctgtatagtcagcacccagctaaagaaacagaacatgaaaagcaccccagaaaactatccttatgctccctttcaggaactaattcttaaaaccattgtcttgacttctgacatcatagattagtttgcccttaagttctttataaaaattgattctttttttttttgagtcagagtttcactctgttgcccaggctggagtgcagtggcatgatttcggctcactgcaccctctgcctccccagcttcaagcaattctactgcttcagcttcccaagtagctgggattataggtgcgcaccaccacactggctaatttttgtatttttagtagaggcatggtttcaccatgttggacaggcaggtcttgaactcctgacctcaaatgatccaaggccaaggactcccaaagtgctgggattacaggtgtgagccactgcacccagccaaaaatggattcttatatgcactcttttgtgactggcttctttgcaacatgtttgtgagatccatacgtacttttgggtgtacttgtggtttgtttattcccattgcagtatattattgaattttatgaaatactacatatatatttatacacacacatatatacacatatatgtatatatgaaatactgcatatatatttatgcacacatatacacatacatacacatatacatacgtatatacacatttatgtgtgtgtatatatgtatatatatatatgtatattggaggccttggccttggatcatttgaggtcaggagttcaagacctgcctggccaacatggtgaaaccatgcctctactaaaaatacaaaaattagccagtgtggtggtgcgcacctgtaatcccagatactcgggaggctgaggcagtagagtatgtgtgtgtgtatatatatatatacatatatacacatacatatatgtacataaacatgtatgggtatatttatacatacatatgtatatatgtatatgcacatatacatacatatgtgtgtatatatgtatgtacataaatatatgcatgtataaatatatgtatatatgtacatatatgtgtatatatgtacatatgtgtatatatgtacatatatgtgtatatatgtacatatgtgtatatatgtacatatatgtgtgtatatgtatatatgtgtatatatgtacatatatgtgtatatatgtatgtatttctattgatgatagattattgagtaacatctaaatttaggcagctaaaaatactgctgctactcaattcatttcatacagctaatattaccctgaaaacaaaaccacacagacagtataaaaaagctacggataaatacttcttatgacctaaattttcaacaatatgttagcaaattgaataaaaatgtataagaagaattatacagtgtgatcaagtgagatttattccaggtatgaaaagctggcttaacattcaaaaatcaatgcaattcctcttatcaacagggtagggtaggaaaaaatagaagattatatcagtttacctagaaaaataatttaacagaatctgatatttatttactgcaaacatgcaccacaagttaagaatagagagaaatttccttaacttgacaaaaagcatctacaaaaaacctaaaattaacatcttagatgatgaaagactcattattttcctcctaaggtttgtaataaagcaagaatgtattctcaccattcttattggatgcagcattggaagttctagccattgctacaaggaaaaaataaataaggaaggaaggaaggaatgaaggatgaaaggagaaggcatacaaattgtaaagaaaattatctccatttacaaatttcataattacatagaaaatctggagagatctacaaaaaaacttacataacaagtggatgagttcaaaaaatcataggatgcaagatcagcatgcaaaattttattttttataccaactgtgaacatacaacaatcaaaatttgaaataccatgcaagctaaaatttttccaaagaaattgcaatctatttgtgtatacttaataaagcatgtacagaatctgtatgctgaaaatgacaaaatgctgatgaaagaaatcaaataaaatgtaaatgatagaaatatattcttaatttcttaataaattaagcatgtacagaatctgtatgctgaaaatgacaaaatgctgatgaaagaaatcaaataaaatgtaaatgatagaaatatattcttaatttcttaataaattaagcatgtacagaatctgtatgctgaaaatgacaaaatgctgatgaaagaaatcaaataaaatgtaaatgatagaaatatattccatgttcatggattgagaagctcaaaatagggaagatgtcaattattcccaagtttctgttttgttttgtttttacacatagacaagcttattctcaaatttatatagaaaggcataaatcttgaattagctaaaaccatcttgaaaaagaaaaatgaaatatgaggaatcattctacctgttttaaggcttactgtataactacaaaaataaaattattgtggtattgatagagagatacatagatcaatgaaaaaatgaaaaaaaaacagaactattcaaatatgccaaactgattgttgataaaggtgcaaatgtagttcaatgtagaaaagatagccttttcaacaaatggttttgcagagatatagaccaatggatcagaacagagccctcagaaataatgccgcatatctacaactatctgatctttgacacacctgacaaaaacaagcaatggggaaaggattccctatttaataaatggtgctgggaaaactggctagccatatatagaaagctgaaactgaaccccttccttacaccttatacaaaagttaattcaagatggttaaagacttaaatgttagacccaaaaccatcaaaaccctagaagaaaacctaggcaataccattcaggacataggcatgggcaaggacttcatgtctaaaacaccaaaagcaatggcaacaaaagccaaaattgacaaatgggatctaattaaactaaagagcttatgcacagcaaaagaaaccaccatcagagtgaacaggcaacctacagaatgggagaaaatttttgcaacctactcatctgacaaagggctaatatccagaatctacaatgaactcaaacaaatttacaagaaaaaaacaactccatcaaaaagtgggcgaaggatatgaacagacatttctcaagacatttatgcagccaaaacacaaatgaaagaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttagtgggactgtaaactagttcaacccttgtggaagtcagtgtggtgattcctcagggatctagaactagaaataccatttgacccagccatcccgttactgggtatatacccaaaggattataaatcatgctactataaagacacatgcacacgtatgtttattgtggtagtattcacaatagcaaagacttggaaccgacccaaatgtccaacaatgatagactggattaagaaaatgtgacacacatacaccatggaatactatgcagccataaaaaaaggatgagttcatgtcctttgtaggaacatggatgaagctggaaaccatcattctcagcaaactatcgcaaggacaaaaaaccaaacaccacatgttctcactcataggtgggaattgagcaaagagaacacatggacacaggaaggggaacatcacacaccggggactgttgtggggtggggggaggggggagggatagcattgggagatatacctaatgttaaatgacgagttaatgggtgcagcacaccaacatggcacatgtatacatacgtaacaaaccttcacgttgtgcacatgtaccctagaacttaaagtataataataataataaaaagtacaccccccaaaaaacaaaaaaaacaaaaagttttgcagcaagtggacatctatagacaaaaaaggagcctctacttaaacttcttactgtttataaaaatcaacttaaaatgaataatgaacttacatataaaacatataaagcagttaggggaaaaaaaaacaggagaaaatcttcaagatttaccatgagacaaatggtttttagatttgacaccgaaagcatgatccaaaaaaggaacaaatgagaaatgtactacatcaaactaaaaaaaaagtagtagaagtatttgcaaactacgtattcaatgaaggactagtgtctagtatatacatagagctctctaacctcaaaggaaaaagaaaacttcaaatgaacagaagacataaagaaatatttcacccaggactatatacagataacaaataaataaatgaaaaaatctttaacatcattagctattagttaaatgcaaattaaaaccacaataaaatatcatgatacccctatcacaaagcctaaaataaaaatagagacaacaccaaatgctaacaagaatgttgagaaatggaatcattcatagattgataatcaaaatgttaagaggtacagccaccatataactagcaattgtactctttggcatttatcccagagaaatcaaaactcatgttcacacaaaaacctgtacacaatagctttacttaaataattgtggtataaacttatcatggaatactattcaacaatggaaagagatggacaagcaacaacttagatgagtcttcagagaattattctgagtgaaataagccaacccaaaaggttactgtattagtccgttttcacactgctataaagatactacctgagactgggtaatttatttaaaagaaggaggtccaattgattctcagttctgtatagctgagagacccctggaaacttataatcaggcagaaggcaaaggggaagcaagcatgttcttcacaaggagagagagagagagagaagaaggagaagagaggagaagggagaaggaggagaaggaagagaaagagaagaaggagaagagaggaggagaggagagagagagagaggagagaaagaaagagagagagagagaaagagaaagacaacctaggggaaactgccacttttaaaccaccagatctcatgagaactctagcatgagaacagcatggcatgatccagtcacctcccaccaggtcccttcctcaatatgtggagattacaatttgggatgatatttgggtgagaacacagaaccaaaccatattagttacagactgtataattccattaatataacatttaaaaaatgccaatgttttagaaatggagaacacattagagcttgctaggggttagctgtgggggacagagaaagtgaatgtggtgatagaagccttttattatatggaattgattgaatctatttttgcctatttattaaaacatcataaagatagaatgttttgagctatatgccttgtaaattccatcttaagtggaaataacaattatgagaatcaaacgtatcagttatctattgctaagtaaccaccttaaatcttggttgcttaaaacagacatcgtttattactttccgtaagcaaaagtcagtcgggtggttctgatctggaccaaagtcagcagattttggctgggttcatttacatctgcagtcatatttaaacagaggtagactgaagataaaagtatgtcaagaaaagaacacaaaacagccaacagtaattttagtcagattttcttttatggaaaagtcttgtttattgctatttcttttcttgttgacaagcttcagatagagactcttcagctttattttgtcagagattgcttattagccaatgcgtatcttgtactttatatgattactgataaatgtcttgttgagttgtatttgaagtcctggaaaaataaacctcttgctcagtcacctggatccacaataacttcagtcaccaagttcactccttgagtaagcaaagtctccacaacatctgcatatttgtggccacacaagattgattattttaatttagtctgacaacttagcaagtgtaaacaagttaatgaaacaaattattgtgcctatgggtcagttaaacaatgtttggactcgtttttccattttctcaagtagctgtttagtaaacgtgacccaggagttgaataaatgatgtaaatgatatcttaacagaattggttgaatattttgttgtcaccagagccagtcaaaaccccaaaataattaactggaaattagtaagaccctctgacagggccagtatcagtttacttttttttttctcaatattcttcagaatactgaacttggcaacggggtggaagatcaaggagaggtgagtttgtttctgtgaaaaagaagaaaacacagtgtacatctgttccactaggttttcttcctctaccatgtagacagtttgaaaatgttcaatggccatagcattcagcttccctgttaaaacaagtaccataaagtattcatgaataacaaaataatcgtattcttttttttttaatgtaagagaacaagatgctaaccaggaaccacatcgatcctgaaagcgctttttggacaaatcacaagcctgtgattaactacaaagagcttatagaaagccagaactttcaaaataaaaataaaaatgttgacaaagattatcaaagaatactgtgcaatatatatatttttgtcattaaaaaaggagtgctcacgctagctgatccttgaatttcattagaagccaggatggctgcctgtggaatgcagtcctttttctggggcttacaaactggaggacctcgctcaggccttgttaaccagcacatgctgtatattaaataagattcacatttttaaaaatcttgatttctacttcttctgaaaaatctgaatatctgcttctgtgcagtcaacaggcctgcatttgtgtatcgtagaatcatctggagctgagcggtggcactgtcattttgtcatactccccatcagtccctttgaacactggggacaactttactcatttacatgagcttccaagtcactgtagacttttgagtccgagccctttgtgtcactctgagactggaccttatttcttttgaccaaggcagataccactgagggtaatagtgtttgtggaactcaagggagtgactccaactttggagccgctgaactccaataatggcatgcagaggctgtgagcctgttcaatacctaagccaggttcatgtcctggatcgaacttgaggtatctccgacaactctgaatctcctgggatccactctagacttgcgagacttgcaattagatttaagagcacgttgcctttagaatcatggagctcaaagaatcagaatgtaagtggaaactgaggttgagagagcttgaggactttcctgaccttcttgacattaccgagttctgaatggggaattcatttaattaggtgagaagttttgtacctcattaatcagttcttactattattttaatttttgaggtcttaataacagcaagtaaaaacatactttgttttatctgccacgagttagcccacagtaacccagtactgtgctacccaatgtgttaactatgttgttttgtggttttttaatgtaatgttttgtattcattcactgtcctatgattgtatgtatgtcagggccaaggtctagcagcagtggcttcatctaggagtttgctagaaatacagcctctctcatcccacaccagaactcttcaacaggaatctcgaacaatatccctgggtgattcatatagtgttcattagactttgaaagacattgacatatatacaatcatataatacttaaatgaatatatagcataatataaaaggactacaaaataacatagttaacaattcaaatgtcttcaggtatagaggtttttgcagctacttccatgcttcagcacagaatggtatggtatttttctgtttatttcattgggctgcttctaagattttttttttttttgaagaacgggtttcaaaggttaaaaaatacaaaacaagttaaaaacaacctgttattttactagcacaaactgaggagagaaactagaggaataaggttgaattagctagacaaagctctgtggagtgggttggtaaatttgaatggcctttgttgatattgagaggcacaagctggccatgaggtctaattggaattataacttgaatcctaaagagcttgcattgttgtcgttgtcaaaagacaaaattacaacaaacttagttatagttctttcttactcacagttcatgaatcaggacagctgccgttctacaaaatagaatgagagctcccactgggcactggcagagcggtgggttttgtaaggtggggacaaagaaatgaagcaacagtaaaaagctgactggttaatgttaagttaatttttaaatgaaggttaaatcagagaggatccacttattacactgactcagggagcctgaaatctcctattttcaggaaaaactgttttttttttttttgcggggaggggatctatctgcttccttaatgtttcagtttgattatgtgtcattcagcatgagtcactccattttggtttgcactagtgttgtgcactagtgttgcactagtgttgtggcctaatgtaggaactcagtccaaagcaatagcctctcatgatctttgattaacaggtctttattgtgtctcttctggcgtgtctgggctcctctcttcttcagctatctcctcccctatctcctcctccttttcttttcccttgccttattcttctgtgttgtcctgccttgcattactaaactctcaatcctacgtgcctgaccaaagagctgatcatgttaacccacaattatctgaacttccaccaagggaaagcatatataccctaggattagagatgggaaacgtgcctgagatgaaaatatttaagtaaggaagaagggttggggctagggttctcctactttgttccgcactacccacacacatgtagttaaagttaaaaaggttgcttgtactctctgatacaatttgggagaacattgaacttactggaagattcgttagtgccacattcagtcaccaggttaggcatagaaggaacagggccttaatattaatacattgattatttcctatgttaagaaattctggaaattcaacgctgtagtactgccatcctgtgtagatcagactgactaggccgggatttccaaaagtatacttttatgagtgcgtgtgatgttgatacagcatggtattgtacactgcatttcaatttcttttcatatcatttggggacatccatatgggtcttgttgaaaaaaaaattacatttccttgtggccaaattacaagaaaaataaaatacaaagttttaggtaagatattaaatagatattaaatattgagtttatataaaacatccaaataattttttaataatattttaataagcttcattttatgagaatactgttttgtataaggttttcttgcttgaacagctacaagtaatttttgaagaaggcaatttaatggtgatcccttttaattctttattatcacaaatagcattggatataaggagtgtgtatattactgttttcttcatttgactgcttctttcttgctagcaaccagaatttagtttctataaattataggtcaaaggacttgtagttctgtaactctcatgattttgatttgttttttttcttttcagtgaaactataatgttgaaaatatttgtgataatgcatgcatatggatttatcagttttttatattgttttccaaaaataatgatgatgcttttcttcaattatagtcagatattgttcttctagtgttaaaaattttctttcagaattcaaataaaatgctggtttaacataaccaatcaaccatttcaatctccctttttaaagttgagtttttctgaatccataaatttggtcattaaatattaacataattttacatgttgcaatttacattttgcataattcacattcttgcaaatttcagctaagttcattccagtgctaaaaaaatgagaagtcgatttttgaaagcaaagttgaaaagtactttggatctagtgatagtgttgtgctttcataactagcctcttgaactccagctaatactgttgtaaataccttatagaaaatttttgttccatatcttgcccttgcacacatttaaagttcaaatatttcctgtacggatagttgcttttgacaaggtaccagtgtagtatgtgacaatttgtttaatacctttgcatgcaaataaataataagtttggaagaaaaaggaagtatcagggcccacaaatagacatttgagagaatcctcatgttgctctttagtcctgtcagcttctgtggtggattcttcatttgtgttataaatctggtgacttcaattttaatacactcttcctaattgtggtgggaaaataaatgtcaagtaaaaattaaatctgtttaagcataaagttctcaacagaaatgacaatctttacaaatttagcaaattaattttctgattattagactattaagtttcagttaattgaacaattaaaaatgtttaacctttataaaatgtgattttaaattttaaaggcctacagtgtctttaataaatcaatttaaatgaattaggctcaattatttttatgagaaataaaaatttgctgaaacaaacaataatcagtataaaattccctcaaacccactctggctaattttaaatatcagaagctgataaaaacataagtaaatccagaggttttagtctagaaaattaacaacacccgttatcttctaaatatcaatatctaaaaagaaaaatgagaaacagcaacagcaatcggaagtgatttctagatgagtaatcacaaagataagcacgttaaagggaaagaacaggaaataacttacatgcactaacaaacagaaaacgtttattgaaaagtaaatcacagagcagtggaggtgattgaacaggtagatgctgtgttttattccaataaagtcttcatctgctgaagtaataattgtcaaattcagaaagttacatacaaatagtgttcgaatgtaatttcaactatttaaattttggaataattgcaaaaatggctttaaattttatcacctcacacatttgacagctatcaatatgtcagggcccacctgtgcctcatttgttgcccctggctgagttactctggcctagtggggaagcaacgggacaggggtgtgggacttcctgggtttgaagctaggctccatggcttatttgttaggtgatctcaagtaagttactttgtgcctcagtttctttatctgtaacgtgatgataatagcctactacacttttggctggcatgaggattaagtgaggacacatatttcatccctgaacaatgtctaatgtagagtatgttctcaactagggtggctcattttgatccctactaccactagtaatagtaatccatgaaaatagggcctgtggtcaaatgataaatgttgaattagggcaaaagtaagcagctgttctaattacagaattatagtacttaatatccttctaatatgcattgtgaatctctgagcggtggcagagccatagtgtatagtgttttctaaatttacatagccgtacgataattattttggcccaaggatctcatgtggacactgctgtgcagaagacattttggaaaacaccagcctcgtggcatccccagactaaatgagcctctgcaacatccttttaataagaaggtcctttccaaagtccagtcccagccctggcccagatcctcctatttggaagcataggcttatgctctgtgtcaaggctgatttatcagatggtaaagcttgatagaactataataaacactcttcttgatcatgctaagtaattttaaatcatctaacactttaaatcagcctcagatttttcttgcttctttgaagacctctgccagagagaacatttggagcactggctccctcagacaccctttgggttgcatgtgaatatttccatcgtatttgaatctgttttcaaaataaagcctgattagaaactactttaaatgtctgaccagagtccaaacaccctcagaagtctttgtgaaatgtcatccatgcccggatcccttatgtatttataatattcctgctgtatctttttcccctgcactgttatgttttagatattcatccccttcttctctccaggaaggagtgtgcaactaatattaaacacagagacagccttcctgagcagctgccaacagatgcacagcccttgggccaagttcagctgtcaaacagccctggcccatgaaacaaagggcagaagcttcccaaccacatgcggatgagcagaaacagctgcatttgctgtagccaggggcccagcatccaattcctgtgattcttaataaaaaaataccaagcacatggaaagggaaaattaaatactattctgacaaataccataattgctaacatcatctcccaggaaggcagcatggcagataacccctattcatgagcctttgtcccattgcgacaatcagtgctcaacacactgcattttagctttttactcagtcaatggcctggcaagagaattgtctttttttccctggagcttgaaaatggagtatatgaatttgggagcatatgaagttggtaggactagctcctggaggtaaaagtacctcagattatacataacaagtgattatatttcaatcagcaacatctaccgtaaaatacataagcctaggggcacttaagaaagcatataaacctgggtttgaatatggtggtagcactcagctgtgtccttcagcaagtttgttaacccatcagagagttagttctctcaactgtgaactgggctgatgtgaagattgaaagaaataatacctgtaaaacccttaacaaatgtctgaatacagtgaaagctcaataggtgttatttttattatatatctatttgctggtccaataatttttataagaccagtatgacttctccaccagagactgaccaggaaagaatgccttctgaatgacctctcttgcagcaatagcacggtaggacctatgttttcctcgaagggttaatttctcattctctggctatgtctagcactaacagttccattagagaatctcttgccctcatgatcttgttctgcatctggtaagctccccacatttgttcccctcttcacatgtcttttgcaaaatgagctttctattggtggttggctctgccccacactttcttgcctttataactctgtgtaggcattttccattctacttcctacttccatcagctatagaaggcccaacacccatttcagctctactccactctagcacagtaattgtagcaggggttttcctaatttccttgagggaagaaggagagagaaagcagaggcaggtaaagggcccttgagagggctccctcacgagctccacacctgtaatcaatgccagaagactcaatgcacattcagaggccaccggtgtagactggaggcagccgagaaagactttgtggaggaggcaagatttgaagaattgatagaacttggcttatggagaagcaaagggggagaagagggagaaggtgaggagaaacaattcctgagtattagaaaaaggtctgaatttggagctttaagatctaggtttgtgatcttgggcaaggtacctaaaaactctgaattttagttaatccatgatgtatatatgggggcggggggtaatgtgaactcagaaaacttgtgtgagaaggtgcttaaaaattagttgaattgaattttatagaagagacactagtagacgtatttagttgtaagatttttattgtgatattaatgctgccacgctaatagggtttaaagatgtagttgaatcctgttataaaacaagcatcatgtcagatccataattagcattaaagtattcattgagtgcccattatgccctggcaagctcatacctcaaaattgtgttcttttacttacatatgatttatactagggtgttttatgactttcaaagaaatttgccttatcaaggaaaccaattatacctgatggactcctgcatactcatgtttttcaatttaaaattatctttgattctactgatgatcagaaaatttgtgaaaattttagaaagtccaaacttttaaagtttggaaaatacaatgaagaaataaaaaatcagaatgaactgtttcctactcaaattttcattcataacataatctttggaatattattaatggatttatattattccaaagtgtgggtatcttgtaatttatgaatatctcatctgttccaagcttttgctattgtaattaaacttgcaatggatatcctttgtataaaaatcagtctataattacttcctttctttgcatctccatgaagggaggagaatgtttcttcctcatttataggctcaacagcccaacttgaccctccagtttgtcacacacatcttttctgcaggataagaaatatcagtttccttgcacactagcagaagtggttcatttccactggaaacttaccagaggcattctccaccagatactgcatttccttaggaaaagttttacctattttgctgagaagattttactcactgaagcataaaaatacatgctctcaagatgaatacatgtcaggtaagttctagaaggattaattttcagttatttaattctggaatttaattagatcaccttggaaggcaaatttaaagaacattcttagacaaggtattcataattcgaaaaggattttcctaagaactgataagcatggtggtgtctttccctttagtgctttttcctgggggcatttagaattcatggaaaacagttgtcaaacctcaaaaaatggactaatgaatgaatataagctcaaaaaatggactaatgaatgaatataagcttttactcaagaattaggaaggattaacatccttttgctcattctgtgaccagatgtcttgtatagggttatatatatttcatttctgtttctctggttaagggcatcagttgaaagtgtttgttacagctgaattgacttgtgcattcatactctaaatattattttaaaatatctaattaatatattattcaccgagcgactcttttttagtagaagctatcacatcagaaactctttattctgacaaagtgacatattgtataattttattcccaaagctaatttttttattttaagacatttcatgagatgttaaaagcccctagtgaagactgttaaatgagccattaaggttaggttatcaatgatcaactaaccaaactatcttaattttcttttgattgaataatagtaacagcaacggtaggaacacacatatgtgcaactaaaaaataaataaaagtaaggacaaactaaaaaataagaattatgcaatgggcattatttaactttgaaaatgtcctataagatttcaagggaaaaagtaaataaaatgtatatgcacgtgcttacattttctggaaacttctgggagcaactattttgcatttcaatatatttttatttaatataaaactaaaaagttgtcttaaatagaagttaaaagcagtttgctttccatacgcaattcattatatcaaattggatagtgttcttggctcagtcagcagcagcagcagcaacattgagtgcccttgggtgtggctctgtattagggtacagctagtaaaattgtcatttgagatagagaaatagtgtcatctcttaagaaatatgctattttcatttaacaaatgtttgttgggcatctataagctgtccagatgccatgctaagcactggggacacaggtatgagcagcatatacatgatcctggctttccagcccttaggttctagtggacactaagacaagcacacaggtactatgagaaatagtagaaagctcctgtgctccaggaaattagaactgaaaacagtttgtagtgccaagtagacaggtggaaaatatgtgtttaataaggaattagcataaaatatagagatacactcagtgtgcattcctatacattcaaatacaggaatgcacagtggcagcaaagtgtggtggtgagcagatgaactctgggcacaaattgcccagtttcaatcccggctccactattcctataaggtaagtggagcaagttaccttttgctctggaagccaggacagggatggtgggcagagagagaaagggccagagagcgggaagtgaggactgctggagtataattaaagcaaagcaggtatagtggttccaagaagaaaaatttctttcaagaagaaaaatccagaagaatggcttgtgcagcaggtggcgtcacacagcatgtaagagagggacttactttaatgctggtaggaaccggtaagaggacatagaaacccagaaagataagggtacttgctcgaatctctcaaccaacaagttcagaaatctcatgtaggacgtggtgaggtttatcaaaatggggcatgggatgcaatgaagtagcagagacactcaataatttcgacttggaagactggaggattcattaccataaaaaaactgaacatgggaaatgaattataataaaaatataatgactgggtgtttagtttgaataaagaatagaacatcactgtgtaataatcgctgagaggtttacaggtcaaatggaagattgttctgcaagagaaaagaaaggtaaacactgcaagcaactacaggccatgaacgatggtaaaatcgatgtgggagacagagcactgaactgggagtcaggatacctggcctctactgaatttttagcaaataacagacttttcctgcaccctagtttcctcatctgtaggcattacataaacaaatattttcatttatgtttctgtgagctcaagaacattgcctggtatttcatattattaagtgcttaattttctattttagtgaaagtatgctgcaagaatttagagacagtggcaggtaaataaagacagcaataaggcaaaaaaaaaaaaaaaaaaaacccagcaaattgtcaataaaaacagtagttaaaagctgatttctggaggcagactgcctgagttcagatcctggctctctgcagtgtgatcttgggcaagttactcaacttcttctgcctcattttcctcatttataaaatgggaataataatattatcttcctcatagtatttgtggaaagattaaacaagttaatatctataaagctgcttagagcagagccttttacatagggagtgtgcaaaattgctattaagcttcactgaggagatgaaactcacttgagctggatattaaagagagaaaggtttggagagatatttcaggccagggaagcagcatgtgaaaaggaagaagcaagcatgagtttgacagttgtgcatggaagataatcgtgtcactttctaggggagaaagaaaccaggatgaataatggagagcatttatttctagtacagaggttcctgctacaaggattaggaaatccggtcatacctacattgtgcctatctctgtaaagagacaatgggacaatactggaggttttcaaaagggagtgacataccatggctttggagtagctgggtctgataggcacattctgattgagtatacattactgaggtcatttggccagggttttctgcaagagtaaggcaaaagataatgaatatttttagaaaatagtagtttcaacatactccaaaaggtttggtattagtgatagaatgggccagggtttaagccatgaaagaaaagccttctctttgggccttttcatctaaattacaggtggtattggggtccctggagagagttcattttgtagtgaaatgctatgttttgtgtggagaagttttctatcagcgcttttgtgaaatttggaggtctttaaaaaaatctgtctaagtaaatggtaactaggtaatttgggagaggaacaagtatagtaatctcactgaaaaagttacagttttatttgctaaggattatagaaatagtaaaaaaaatgtgaacgttttcatgggctattacatgtatgtctttgttataaaattttattgcttaaaagatgtcctcatccacagccatgtcacctgagcctgtgcagtgctagtatttgagcagatgctgagttttcattttgcttcaaagtccattaattcagaactctttaagagtgcctttaaaagttcaaccacatttaactcatcttatctacctttgcatttcccatcccagttgactaaagttttttatactataagtgatcacatgttaagtaagatctgtaaatactgctttagctctgggaaattgtttgaaagcactttaaaacatggagtctttctccattattgtatttctttctgtatttattgcctatcatcttaaaaaaatctgaaaactgaagctatgacaaaataatgaatttgaacatatcacaagttgataactaagataaagaatgttcttttataagacattgcaaagggaggttttatcctctgtaagtatgccaaaagaatctacttggtctcaggtgttgccattggatgtcaacagtgataggccatttaaagataaggccataaactgatatctagagaacttttgattaattagcagctggaggataaatgcaaagaagcttcttgagtgtctagatagactaaagtttgctggatgaggtagatagagacatccttctggtggtttctctattgtctgagaagcaaatgctaactgaatatatagatagacattacacacacacagaaatttttaccttctctcttttcacaaccttgctattgccctttggcaatttcttcttcctttatattggacaagactgatcctgatatcatttgtattagtcagtgtccagtcaggaaaatataaaccatatcagatattttaacagaggaaagttattagaggaaattggccaaacaagtactgaaggactagatttgagattttacagagctagttatgaaggaagcagctaccacttctaaagtggtggtggggtgggagtggggcagggagagaagatgtttggggttcttaggatgaagaaacctggaaaaggtgcctgtgaaactgaagtccagacctttggatggaggggctctgtttagctggtagcactatatcagaagctcagagaagggacactacagaattggggcctacacctctaatgagagtgttgcttatactattttggggatgctgcaacaaaataccttagactgggtatcttgtaaataaggaaattatttcttacagttctgaaggctgagaagtccaagatacaggtgtcagcagattcagtgtctggtgaagatctgactcctggtttgtagatgactgttttcttgtgtcctcataaggtagaagtgcaagaagtctctctcgggcctcttttatgagggcactaatcccattcataagggctccatcctcatgatctaatcacctcccaaaggccccacctcctgatatcttcaccttggagggttttgaacatatgaaacttaaactctggattttggagagacacaaatatttagaccatagcagggtactttgccaccacttcaactatctatgaggggtcacaatgaggctggtttgggaacactcaatgagacgcaggaaatggaaccaactgctattgccaggatgaaaggccattgttgaggtgacacctgcaggaatgtgagcaaaactggaagaaacaagtcctttgtttctcctccagcctctaataggttaattacagcacaagaattttaactaagcgttactgttatcaaagcatgctgatagaaggaccttggagaccctctcaccatacacagacatatatatatataatatgtatatatgtgtgtatatatacatatatatgcatacacatacatatatacatacacatatacatatacatgtacatgtacatgtgtacatgtacgtatacatgcacacgtgtatacatgtaggtatacacgtgtatacatgtaggtgtacacgtgtatacatgtgtacgtgtatacatgtgtatgcatgtgtacatatacgtgtgtatgcatgtacgtgcgtatacatgtgtatgcatgtacgtgtgtatacatgtacatgtatacgtgtatacatgtacatgtatacgtgtatacatgtacatgtatacgtgtatacatgtacatatacatacacatgtacatatacatacacatgtacatatacatatacatacacatacatatacatatacacatacatatgcatctatatatatatgcatatatatagatgcatctattttatagatgcatctaagaatagggtcagtggtgaaccataaactagaatgatgagtatgattcaggaaaaaaaaccaaaaactaacatcactcttgttcccattatgggtctataattttattaagttattcagagatagcatctcagttaataattctcatttaataatcccaacagccttgttagagaagtgggataatttccatatcgaaaatgaaaacaatcagactcagaggatttaagtaatttcagtcagtcagtaagtagcggataggattctggccaaggtctgtttaacaacaaaggacatgtttgaactctcatccccttcaatggaaaataaggcaaagccaagaagccaaaagtacaggcacccaacaaagtgggaggcacagaacaagggggagggcaggtatgaacatccagagcgactttgattctagggagatgctcactcgtctacggaaggtgtattgtattcagtttctgtacttccggtcttcactctagccttgccttctggattgttctaccaagtactttggcttttctcatagtctttcaaaaattgttaatattattttgattgaccagtcataattgtacacatttaaggggtacaatatgatactgtgatatatgtatacaatatgaaattattaaatcaagctaattaacatatccatcactccaactacctatcattttttatggtaggacatttgaaatttactctcattttgaaatgtgcaacacattgctgactatagtcaccctaatgggcaatagatctcaaaacttattcttctgcctgtcctatttgaaacttggtaccctttgaacaacagctccctacttcctccctccccctcccctgccaggctttggtaaccatcattctattctctacttctgtaagtttaatgttttaagattccacatataactgagatctcaaacaaactcaaatcagtatgtcaaaggaatatcttctgtcttagtctgttttctgctgctacaacagaataccacaaactacgtaatttatagagaaaagagatgtatttggctcacagttctgcaggctgggaagtccaaggtatgatgcccatatcgggttggcctggggaggttgttcttgttgcattgtcctttggtggaaagcaactgagcatgtgagacagggaggaaattgggccaaactaattattttattaggagcctatttctgtgataactaatcccatgataatgacattagtccattcaggagggtagagccctagtgacccaatcatcacctaaaggtcctacctctcaacattgttaagattacagttaaatttcaacataagtttcagaggagacactgaagacacagcatctgcattcccatgtccatgtagctattcacaatagtcaagacatggaaccaaccttaagtgtccatcaatggatgaatggataaagaaaatgtgttatacatatgcaatggaatactattccgctttaaagaataagaaaatctattatctagcacaacatttatagatctggaggacaacatgctgaatgagataagccaggaacagaaagacaaatcccatagtcctgaagtcaaatttttgctgccacaaactgacgcgtccatggtggcagctatccctgatctctcatgctattcatgggtatgatacaacagtggccaacttcattctcatgcttttcacttcttgcctcccaccttgggggttttcaatgactgcttagatatgagacaccagggcacatgctcactcctcatgcatgtgtaatccagaaagggcagggagttaacaccctttggagtgaactttgagcaagggctgttagaatgtgtagatgcatttttctcccttcctctccctggatgaactcttcacatttataataacgtcagttggcctctttgaagatgtcctgcaaggctaggcaaacagcttcgctaagctggacaactctatagtacactccattatatttgtttccccttacactccttttccttcacttctgctgttttgggactgcgccatctcccaataaaatgttagcacaagatgcttttgcaaaggcttttttttttttctgggttaagagcagggactgggctgtgaaggagagccataggctaagatgataggacccacaattttcttagtgtctggtagtaatcccaggtatccatcagttcaggaaggtaggtagaaactataagtagattaaaacagggtagcaagaaggacttctgaaaaagtagtgagaatagatctgacagcttccacctttatggaatgaaagcttcatcctgtagattggttcttgtgatgcttatttaaaataaatttccttaaatgaggcccaacatgaaccaattctccacccctgtgaaaattttctattgccagtttgaacttctatgggtgatcatacaatcgcatagcttctgaggagctaactttcactcagaacttaggattcatctgttgtcacctcctctggggagaactcactggcccctctcctttctgccagctgttgagaatattagggttccctcttctgtgtttcagaggtattttctcatttctatcgtggcacattttatgctgtttctgcacaatgcagagagatcctgaaagcagagaatatgccttagccactgctgaatttctagaaactaacagaagcctgccacacagtagccatttaacatggattgattccattgactaaattaaagaattcatgaggagctctgatcatggcctgaggtttgcagttaccctattgaacaaatcccagaagagaatttgcggaattaggtctacatgtaatacacatttacccacatgatgaaataagatgacaagagctttgtggtatcaaaatatctatgtctctgacaattttcacaactttacttaattatattagggttaagtattggaaagccttgatacaatgctaatttggaagcattataccaaagtgttagatcagattagccccagttctcttctaaatagttccagaaaccagatttggacccagtcagcctaacggcagtaaaaaccaagacctgtctatcatgctacactgctttcttcagatgacaggggccttaagagcaaagtaagatattgattggcctccaggatccaggaaaaacaaaacaaaacaaaacaaaaaagccagaaagaatacaaggtgaaggcaagactgaaaggaaaatagttttgatgtactaggaaacaaaatcattgaatctgaaacactgttgtctttggaatatcctgagagaaaggagcccaacacaggtcatttggctggaaggaagatcaaggcaggagtccgtctggtgcgtggggttctccatgggagactgtcaacagctaagggcagcggagggcaatgatgaatgcctcagagccgagggccacagaaaaggcactgggaacactttccatgcacttcatacctatgactgagaggatggcctaggcaacctgctttagggtggaaactatagttacaaagatgagcagtcacttaatttactaatgaatgaccccaggtctcatagcttttctttaggaaggattatatagtagttaaaaagtgcatggttcccagatatagaaaaatctgggtattcaccttggctgtaccatttactgtgtgaacatctcaggctactatctttacctccatttgtctcagctggcacctccttaaagcaaaaataataatattacttcagagggttattgtggacattagagaaatatatgtgaaacacctgtccaagtagcaatggtgagtgtgcaatgaatactagttgtttatcatgtgattattagtctaattcttgcaaaatgtcccagcctttgtgttttgatgaacaagaatatatttttaaaaaattaaaaaattttgttgtcctcataatatagacatctgctccctgggacctaaaaagcaatccataattttccaaagctgctaaaaaatctgccatgttctaaatgacctttatcaagcgatctcctagtctagagaggcggaggagtaacttgaaggtgaaataccccgttagcaatcccccaggtgaatagaaaatttaaaataatattctaatgattcattgtacattactacgccccattaggtgtctacattacatcttggggcacaatcaatatctgtcatcctgcttatggttttggtgctagagcggttcaatttcattttgcaactctcatgctcatgaagctgtatctcgggtgtcatatgataaaatattactcagaagtacgtattcagtcctaaagcatagtgggaaataattgatgaagaaagtgtctttccatctggtcaaacaccattaaagtgaggatacgatttatatgagaaaaaacgaagattgatattccttttttttttttttttttttgagacagagtctcaatccatcccctaggctggagtgtagtggtgcaatcttggctcactgcaacctctgcctcctgggttcaagtggttctcctgctttagcctcccgagtagctgggattacaggcacgcaccaccacgctcagctaatttttgtatttattttatttattttatttttttagtagagacggggtttatcatattggccaggctggtcttgaactcctgaccttatgatctgcctgccttggcctcccaaagtgctgggataacaggcgtgagccactgcacccagccaaaagactgatattttatgaaactttttggtaaatccacgtgagagagaaagtttttattctgtactcaacatagttccattacaagcatttttcaaacatttaaactggattgctacttacaaaattttaatatagacaagactagttcatgaacatatcccctttataaatacaggtaccagtacgtagacatatatttcttgtatttaaaatttaaaaaatcatactacattttagaatatggcaaagcttaagagattccaaaacagtcatggataagtaataagtcacttgtcattgttctatacaaaattaatgaatgagttaagtaacctatgttttgagctgtttcctttcagaattgaaatgccaaaggagtgaccctctttttctcatgtgggtgcacacaagcatactccaatcgaaatatcttccccacacattctaccatgtggtagtacctagtaagtactaacctactcactaggttagtagagacttgtattagaattcagacatccttgggagggttaaacccacgatcaagtgactcatactttcacatgaatttttgaaaactttaaatgtatgatttctatgcaaattgagatcagactaagtgtgaattctacttaaaagagaggatttcggagtactgtggaataggacatgccaaggcccttgccacagcttgagacagacagaagatgacataaaagtgcgtgtgtgtctgtgcaagtgtgcgtgtgcatatgtgtgaagtataaagggcccatggagggctatagagatagatggataagagttgaaaaatggatttaacttggactgctcttctgttcaagatgcttttggctgctgcaccctttgcaatggctctggaaaatcaccaatagcatggggcttcatgcacagatgctctaagtgctactcgacttacccaactttataaaaggagggatgtgcacagctagtacatctgtgatatttgctttgggatcagaaatactaagtgggacagtggttttctttgatatagggagatgttcaccttaaaaatgactggaaaagtggcttgatttggtcttcaatatctaatcatgaaatggatatactttataaccagggtatatagtttgggagttttgactgattataatttatgtcatttcttttaaaaggttgagagattcaaatgccttgatactgatatatcaatgacacgttggagatgcattttttgggttttagcatactgaagtgaaagtcagtcaatagaatatacattgattccagggtaaatgtcccaaatttgagaaaagaggttatcctgaaaggggagaaattatctcacggtcccaaacaatatgttgtttcattacactgtttgtgggacaagaagggaagggggttggatgcaggattaagacaagtgaaactgtcacatagaaacatgaactctggttgggacaatctcaaaatgctgcaggtgtttgtaaagcttgctgagattgactgggctctcctattacttacttttgatgctggattttgtctgacttttgtcccataaaaaataagacactagaaaggctttttggtttttataattattcatcagtttctattttcacatagctttggagcactgtagaggatcccttgtatattttagaatgcctatgtgggggaaagaatcacaagtagtaaagagcttaccttgatttttggaatagatatgttttaaccaagtgtagtaaagtgaatattctactttctagtcatttgttacagaatcaggcactactacctccctactgtcacagtaagtagctgtagtctttctataacttaggactggtgtggggtgatttttgatgggtaaattttcaacattcttatttcagtcctgaattttagaattttgttgacatacacaggattcttcaatagccttctatttagtcttctatttgccacttcttatttccaactcatcttatatgttactatgagacaaatgttcattaaacattacttttgtttgtttttgagcaattgcttcttgaagtgccagttttctattgctcttgtgtataatccacttttctctttctggatttgaaggtcatcctcagttttgctccacttgatctcatgttaacttcctgcccctccttatcatgaaaagtactccagcctgcaactaagcccttctcctcaccctctatcgttgtctctatgcctgccttatgctattgcttttcccaagagtacccaccccaccctcttcttcctcctttttataccttactgagctttaagtttcaccttaatttctacctgtataataacaaagtagcttgcattcattgagactccacaataggccagccactattctcaacacatgtcatgtatatgttgttaaatgttgatatcaccctattggggaagattcttcctctaccctctaagggtctctggcagtacctaagaattaaattaaactgaggtggctgggcgtggtggctcatgcctgtaatcccagtgctttgggaggctgaggcaggcagatcacaaggtcagaagttcgagaccagactggccaatatggcaaaaccccatttctactaaaaatataaaaattagccgggcatggtggcgggtgcctatagtcccagctactcgggaggctgactcaggagaatcgcttgaaccggggaggcagaggttgcagtgagccaacatcgcgccactgcactccagcctgggcaacagagtgagactctgtctcaaaaaaaaaaaaaaaaaaaaaaaaagaaggaaactgaggtaacacagatcaacaggagaatatcatacacaatttgctaaaattttacatatatgtggaagtccttacaaaacaaaataaaaaaatatagacccaaagaagtgaccaaaacagatagcttatataccttttagacaaagaaaggataaatttttaaagaaatgataagacaaagggatttgggctaggagcaataaattgtagggaagtaactaacagatatattggggaaaactagtagaagataaaggttattttagcaagcttgtttgaacagattcatttcagcattgattcccagtctctggtgattagagtgttcctcttttcttggtacagggagagcacctttctcaaatgaaatttatgtgtttttttttttaatggcccatttttaggtagcaaaggggaggtcagagaccccttcctgcatctgctgttcctcaagtatctccaactcaaaataatcaatatgcccaaatagcatattttgaggtggcatgtcctgaactccttcaaactgtataaggtagttctacatctccattttacaaataatggcatcaaggcacaaaggaataaactcactaagggacacagttgtgaagtcactccgctgggacacaaagccagctgcctgccccacaccctgttctctctgccactctgctgcccttcccttcagtcttctcggactctccagctcattctgctttcctctatctatgaacttatatggtagctgttttcaaaaccgtacagtttatcatttcattgtgacgagttcatgcatgttagttttttctgagcaattacatagcaagatatcttgaaatgatttctatgcctcattctactttctttccaaagcagtcctggctcctggtaagaactcattaaatactttgtgattgatagataatacaaataatagagataggaggcaggggaattctgggcagaagaaggcaggtccccggcaagggccccaacctcaagcctgaaaccacagcccaaagtgagaacatacatacctgttttcccactcaaatgttgccttttccaaaaccacccatggcctgtcccactcccaatcctgtgcccataaaaaccccagaactcagccagcagagaggagaagcagctggatgtggaagactatggttagatgtcagagagaagtgacttgacttcagagggacagcttgatggcatagctttggagaggaatccggccgttcctcctccatcccctttccagctccccttcctgctgagagccactttcatcggtaataaaatcccctgcacttaccatctccaatttgttcctgtgaccttattcctcctggatgccagacaagaatttaggtgccatgagtgcgggtacaaaaggctgtcacactgaccttccactgagcttttaacacttaagccatccagccatccacagatggcaaagttgaaagggcactgtaacactccttctagggcttcaggtgttgcaggcacccccctagatgctgctgtggggtctgcacaaagttttgctcctgccggcacccaaaaacactcatcctggctcccgtgtccactcacctgctctccccctcccacaaaaggtggaacacaactgggccaagcaagtggagtctgaccctgccagcaccaaaggagccagctagcctgtgaaggcatcagggaagtatcatgcttcacaaagacagctctcctcccctcctatgatacaaacaattgtattgatttttgtaattcactctgactatatagaccaagtgccttcaagcacggtgacatactaaaaagtatacatttcatgtgactgatctacaaagtagccctcagcttagctgagagttgactagcatcctgcaatggtttctgagttgggctccagtgggtctgaattattcagttttcttttttttctttttttttctttttttttttttttgagacagggtctcactctgttgcccaggctggagtacagtggtgtgatcttggctcactgcagcctccacctcctgggctcaagtgataatcccgcctcagcctctcgaatagctgagactacaggcatgcactacaacaccccaggtaatttttgtagtttttgtagagacagagttttaccgtgttgtcccggctggcctcaaattcctgggctcaagccatccacatgcctcagcctcctaaagtgctggcattacacgtgtgaatcactatggccagccttcagttttcatttgcattgttctgaaacaattttttaacattccatgttatacaaacatcacacaaacaagaagattacaccatttgtgatacgtacgtggttatagttcacataataggagacactattcaactaccttaaaatcagcttactgagcaccagaaacaacatgattcatatattggcttaaaagtccagtatcactgtgattttcctgattttttctttttttaaaaaaaaccatatgatgattatgacttgaggttctatccgggattgatactggaataattcttgaaggttggtggttggggacagagacctggtaatcaggcagacctgatttggaatctcagctgtaccactgattaacgtggcaattttagcaagaaacttagcttctctgaacaactacttcttgatatctaaagtgggaataataacccctactctgcagggttgctataagaattaaattcaataatgcatataaaggaattatactttctaccacatggtaattgctcaataaaatgtttttattagtggtaatcatgtatccataagcatagtaattgatatatgctgactcacctgaaaaaatggcaagtagaatttggaaatgacagcctcttttcttccttttttccttctttgcttccatccttccttcctttcctctttctttcctttcttcttttttccatctctctctcctccttttctttctctcttctttgtttctttctgaggcataatttacatacaataacatgtatttattttgatgtacaatttgatggattttggtcattgtatgcagtcaagtaaacgtccttacactgaagctataaaatagtgccatcaccctaaaacatttcctcatgtccttttgcaatcaactcctcacttccattctcaacctcaggtaaccactcatctgtttttgatcactatagtttggtcatttctagaattccatatacatggaaacgtaaattatatagttttttacattcgatttctttcacttagcatactttttgtgattgactcatgttaagtgtaataatattttgtttatttttattgctagtaatgtttcatggtatgaatatatcacagtttgtctattcactagctgatagacatttgggttgttttaatttttggctttaggaatactgttgctataaacacttgattgcaagctttcgtgtgaacttactctccttacagggcttagtgtgcccagaaaaaggacactgggttacaatgggaagtatagcacatcagagcatctaagttgtgtcttctccttgcctctagtgatgataatgagagtaataaagccgactttcatttatctagcctgtttcctcctctcagagaggctgctttcacagcccccactgtccccaaagagtcaggttagcttgtccccatctcatcactggttcattgagctgtggtagacacctgcctcaaactggaccaaatggattttctaccctgagaacgtgaaattcagaaacagggtcttttaaaattaattatgtatgcttaaactagaggtaagatagacttagctaggatgggcaatttgagtcgaataccaagacaaccgacatctccagtgtgaggaaagagacagcgagagtgagaaagagagagagagagagagaaagagagagagagtgaaactgcagataagcaatgaaatccagaaataagagactagatttcaagacagagaagtgagctatatttatttcaccctctttcagtactgtaagatgccacaaaatcctttaaactctgtggttttgccagatgctctgaaagtgttccagggaactctctctttggtttgaactaggttcagcaggcttttgtttctgacaaataaaataaccaaataatccctgactgagacaaatcataattgttatgaagatttgttgaatcctaactacctacctactttaataataattctattaatcctttcttacatcggatcaccaaaacaaccctgtaaggaaggatttttctttgaaggaactgaactaagaaatgagttcagttagtcgagaaattaaataatttgtataaggttacatgtttggagggtagcaggcctggagactaaattctgaactgcttttccccaaggtctctgatggaaatagcagtcccatgctggaccctgggtgtgacatgaaggagacagcgtagggctccatacagctcccccagcttggtgatctctctttatatatctaagaaagtgagtggagtaataggcattgagagggctcctgtctatggactccactttctctgtgaatctagattatttgctgttaataagggaagatttgatagtgttggatatttgaaggaagtcatttgtgaatgctatcagatgccaatttggaaatgcagaaagattataagccagtatggtcctataaggactatatttcatgtaagtaaagttgagagaaatagagacatttccctcttaaatgtttgcctgttggtttgtttttacattcattttgtggaggaaacacatgactttaaaaaaatgtaaactatttctgtttcttcttatgagtgaatcgtggtgggaaagacttcatggacagagtgaaaatgaaagaaatgctttctaaagcaaaacacagaaaaggagaaagctggctaggaggtgataaggaatatgaaaagactccaggagttataagagagaactcagaagttacagtgattcccctgcctggtgggcttcagaagcatttgtagaatgagtgcagcataagttttagtcatgcaatttggatgtgaatagagactttgcactatctggcctttcaccacttccttttcttttctcaacttgggccttctcatcagaaactgaggattgttacacctcacaggctagttgtatcaactaaatgggctgtccaggagtggtggctcatgcctgtaatcccagcactttgggaggccaaggtgggtggatcacgaggtaaggagtttgagcccagcctgaccaacatggcgaaaacctgtctctactaaaaatacaaaaattagctgggcatggttgtgtgtgccagtaatcccagctactcaggaggctgaggcaggagaattgcttgaacccgggaggcagaggttgcagtgagcaagactgcgccattgcactccagcctgggtgacagagcaagactctgtctcaaaaaaacaaaacaaaaaaacaaaaaacaaacaaaaatcctaaatgggttaatgcaagtaaaatactaagcctgctgatatagagcaggtgctcaataaatgtcaggtttcctatcaccacttcatactgttctttgagacattcattggtttttcaactgtttgcctttaggaggatttcttctggtctggacaatcgaagaggttcacagtgatgcacgtcatttcctggcctacagtgaagtgacaattgtacactcaaacacaaatctagatgtaaatatcacagacttatttgtagttattaatttaaattggttaaaacaccttcttagttacagataccaaagagcttaagtatgtggtttaaagcattagacgcaaaaggtattacagacgcattcagggatgatgggtatccccggatcctaaggcctagtgaatggtctcttctgtagaagacagagaggataagagtggggactaacaattcaatcttataccaaagataaataagtatgtatagatatcaacataggtatataggtatagataaataggtataaatatatatggatatagttctaaagcatactactttacactctgcatacaaaatatattagttgatagctttttatatttagccttgaatattcttttgtgcagagagactttataaaatcaatgtgactccaagaaagtattagcaggaattcaggccctgagaaagacaagcttatggagcaggtaaaaagtttcataattgggtcctccagtgttgtgctaaatacagacagaactgtcagagtaggcttttgacatttgcccatttattcttgcactaaaatgagcaatttaaaaacggttggaaagaaatcagtggctatttttgaacaccatcctctgaaagtacagcagataaaaacaaaacagaacaaatatatggaaaaatatgtagctgatatcagggaagcccaaaaaccaccttagagttacacattttccaagatctcaactgagcttctgaaccactcccagtcaaatcaaactcgattatttgtaaagatgctgtctaatgatcagtagaaagtgaagacacacaggatatgtctccatcagctcttaacacacgttggctcccaaaccttacaatagctcaaacttctcctgcaagtttgatccacaaagtgatcctgaactaacacgagcagcccaggcatgatggcatcaccccagaacagaacacttcctccaggcatacattgtctgtgagcttcaaattgcttcttgtcctgtattgtttccagatgatgagttttccataaatgttgtctcttgctagaaaatgttatattccagcatctacctttaaaggcaactatcaaaacaataatctttaaagatctgcagatgcctgtggagatgagactcataattactctgatgaaattgttgtctttgaacatagcaatgaagagttatttttatttgggaaaaagtgtagaaataagaaaatagcatagtaaggctgctcttgactttcgtacagcttcagccttttcatgaaacataactcagatgatcttcttctgaattagtgaaccctgatgttagttatataaccaggggaccacggtgtcagccttgttattttaagggtcttttccagtctgcaagacccaaccaatttccttcacctttcacatgtggacttctcattgttactaaactaaccatcccttcctgctcatctctacacatactttaggacttattgatttcatggacgttcatttgtctcacaaacttggtgatatagaaactgcattttctgctttggtgcaccccttagagagcctagtgtggttcagacaaacctgatgagatgcacaacttggaggtctcgattttctcatctgtaaaactgggcaagttgttataaggattgtgatactatacaggaaagtgctaaataccgcaggcacagatgaaaggaaatctttccctctcctggcacaatgctacggatgcaaacaaacacattgttttacctttacatatcatgagttacccagagttttctcgttcatgtatgaagggagtactaattcgtcatcaccaaagcatgagcatatttagaactggattttgagttttgtaaagatgtgtaaacttcccaggtgccagtagcaggcctgtgtagatgttgtcctcatcaaggatcagggactgcttgttgtcacgttcctgttgaggaatgcctgcacctctgaccagcctcaaacactgctgtagaggaaagattagaaatataaattatgtaaaatgcagatcattgactgaacatttgactgttcaaggagttgcattttactgcttggaataccttttaaagtgaaggagaagaaaaggaggaagggggagggaagggaggagaaaaagaagaggaggaagttgagaagagggaaagttgctccataatttacaaggctctttttttcacagtgggattattatttcccattatcacatgaaacaatcttcattacttttcttaattctgtcttcattctcacttcaccttgtccttttatatatgttctctcaacttgggaataagaaactggacctttacagctgggcacggtggctaacgcctgtaatcccagcactttgggaggccgaggcaggtggatcatgaggtcaggagttcgagaccagcctgaccaacatggtgaaaccctgtctctactaaaaatacaaaaattagccaagtgtggtggtgggcacctgtaatcccagctactcaggaggctgaggcaggagaattgcttgaaaccggaaggcagaggtggcagtgagccaagattgcaccactgcactccagcctgggcaacaagagtgaaactctacctcaaaaaaaaaaaaaaaaaaaaaagaaactagagctttacgagaccaaatatatctgaatatctgaggctttagaaaaacagaagaaaggaaggaagggaggaaaaagaaagaaagaaagaaagaaagaagaaacagacaaaataaaagctttggaattgctatagaaaggattagattagatgactagctaagaccttttctcgtgtctgtatttggggaagagaaggcatgaatttccccttttagttaggtaaacgtatttttatattgagaacctcttgcataaggacaggtgaattaatatactcattgaaaatgaaatgacttcagagctcaaaaagatcttgagaatatctggcgcagtgtttttgaaacttttaagaaatcagcataattattccccccatttatatttcagttaagtaaaattgactctaagtgcataaaatacgggaaacctggctactagggtttgaatcgaaagcagggtttgtgttatccaaggcatctttcctccccttcgctgtccttctctttctccaaggttaagtctgaggagttttctagaaaacctcaaattcagtggaacacattctacctccatcataatgtgaaaagaatctgtggtctaatctgatgaaataatttgctcgtggctagctgataaaaagcacttgtagctaacacatattgagtgatgaacctggactagatgcatgaagtacctaatctccccaccaaccctgtgatgtacacactcttatgacactaattttatagagaaggaaactgatttcagagagcttaagtgattagaagcaaatccatgactagaccttggtgtccttaaccctcagggcaatgctttggcactctacaatcttacctcctagaaacaccttcaaaaccaccctatgattagaactgaattttagcatctacaaaaattcacagttcacttttagttctctgttttcctgggttcttcccaggaatttaagttattttgagaccagagaagcttaaggcattgacattccacatgccctcaggatttaacttaagctccaggctgtttcaataccaaagattttgcctcaaactttgccaccactgagaacttggggatgtgaaaaccactgaggcagcaatggcaaagagaagagtgggaaaggcctttccaggatccatgtgcagaattagatttgtgtaccacctgtgataactgggaaagatcttttttttctggtttttttttttgttcctttttttttccacgttggaggcaggaataaagcaggtgagggttccatcagagtatctgccctaatttcctgtaacagcaacaggagttacccattactcctattgccaatagatatcatggcttcactcctaaaccatactcagagcattcacttgttgatgttagtaaggaaaagcaagttgtgcataagcagtattatacagcatgcttcagtacagtttgtagctatttgcttaactgaaatctaggtacaagcctcttcaaataacagatcttctttttctgtatgttccttaaagagaaagaggaaagagaaaagaaacatgcctggagtgagcatttatcaccaagacaatttccaatttcatctcacgatcaggtttacttcccaatattctacaaccgtaccattttatcatgggcataaacattgagaataatgactcttgtgtcttttcagagcctaatttgtgatgagagaattttaatgttggaaacaaactttaaaggtaccgaagtccagacgtctaatataccctagaatctctctgcagctcgttggcaacagacatctggcccagctgtgatgctctaataagtccaggcaagaggaccatagcactttagaaagacatgaagcttactgaagatatgacttacaaatagagcttttggtacagtgcagtctgaaactgattttcctaaaaataaaatgctcacgtaggtctcaaataaaggtgcctcgctcctcagatagatagaaaatagtacaacacccaacctaaatagtcaaaataaaaatattgtgtatccaaaaaaaagttttagaaatgtatttagttaccacttggagccagaggtagttgccaacccaatttcattataagtgaaatttctagggtattaaaaatggctctcctcttcttcttcctctcccttttccttcttctttttctgttgattttttatcatttaattttgatccacaattctgtataacatctacatctcatatcaacctttttttttttctagaattattctactccctgggtcagtccccaagatgtttcacttcattatggatctccttagcgctggtgctaaggttaaaacattaattctccgcatgctgagagttacttagctccatggtgaagtctctatctgccaaaagtctctgttcaaataaatatgtaactggtgattctacagcatgcattagaatcatgcagagggtttgttaaaacacagcctgctgggccccaccctcctaagtctctgattcagtggatctgagggagcccaagaatttgcatttttagcatcttcccaggtgctgcagatgttactggctcagcaacaacacttagaacaactgttctagaaagagagtccctagaactgttgcattctagttaaagatggtgggaatgggaggaagacattgctctataccaggctgttatgggcaaattcgggagataattgtgatgaggttgaaaggtttgaatttaatctccaaatttcagtcagagagtaagattcattaaggcttttttccatccccctgcaaagtccattcttccagccagctcttgctccagccctgctgtgatgagactctgctgttttctgttttagctacttctgcagctctcccaaccctggaaaagatgaagaaagatgatgattttgttctcagctcttagtctttagcctttggacagccatcaaaagtacattttaaggaaaagggggaaaatatgtctactaggagaaatgccttgtattagactattatatcagtgatttgcttttacttaatgtagtattgaggagaaaatgcctctcttttattattcaaatggtttgcttttactttaccaaattacaagaaagcataccaaatgcaggcttctaaatagtttaaactggtttaccacattaaactcaaaagagagtatttcattaaaaaatataaatggactggagctgttttctgacaatacactgttgggctttttttaaacttctacttttgttttatgaaccgaactactggtgtttaatactcaaagatgctcagcttttaggtaatatttgttgtaggaattcttaaaagccacagatactgctaatggggaaaaaacaacttttcttatgttgaggttatagcaactttggtggataacagttaatacaattagttttccatcagtttctctaaatgcattttttttttctaactaactttagggtattctgtatccttggcattgatttagtgagatcttcattacatggcatttcactttagtttccattgcagattgatatcacaggtaataactgaatctttagggtttgaagaagctgacctttctttaagagatctaatcatttcacggacaagttccagtggtatttctattaagaaatcagggtatggctgggcacagtggctcatgcctgtaatcccaacactttgggaggccgaggcgggaggatcacctgatgtcaggagttcgagaccagcctggccaacatggtgaaaccccatctctgctaaaaatataaaattagccaggtgtagtgtcacatgcctgtagtcccagctactcgggaggctgagacaggagaattgcttgaacctgggagacggaggctgcagtgagctgagatcacgccactgcactccagcctgggtgatatacagtgagactccgtctcaaaaaaaaaaaaaaaaattgtctgtcttcatggtaagataatcaggactttaaggaagtgtgtaagacattttactcatatttttattaccagtttacattatggtttctaaggccattatgtgaatccaaataccatcttgaaatgaaaacacattaagctatttttaatctgcaaattatttgatcagctgcctcagatacatgaagaatctgatggcaagggcacagaatagctaaagtttaacgggaaagctggtactatccaagtcagtgaggtgaacacccagctgcagagcggaggctcagaaatggtgagtgccaagatgaatcaagccacaaaaggaatgtggaggacctctgaggtttagcttcatatattgggcaatgtttctataggcagtcattggcctttcgtcttcgtcttctgcaccgattcagtcatttcatttgtagagtcttcctcaacatattgtttaaaaaaattcaagatttttcaaatttggttttaggatttcaaaaacaatcaggactagtatgagctattcattttttttttttttttttttttttttttagatagagtcctgctctatcacccaggctggaatgcagtggccaatttcagtttactgcaacctctgcctcccaggttcaggtgattctcctgcctcaacatcctgaatagttgggattataggtacccaccaccacgcctggctaatttttgtgtttttagtagagatggtgttttgccatgttggccaggctggtctcaaactcccggcctcaggtagtccacctgcctcggcctcccaacgtgctaggattacaggcatgagccaccgtgcagggcctattcattgtttttttgttaattctctaaggattaacttttgggccatgttggactgacagattctgtcctttgctctgcttatgttttcccttctattttcaggtagtgattaagactgtgaagacagaaggtctgaattagcaatttttcaggcagctgacttaataatttagactaaaattcgttccaggatgcttgctcacctcctgcatgtggtgtcctagaaagcctcttgtttctccagctgtcctccccggcagcattggcatcacctgggagattgctagagatgcagatcccaggccctcgcagatccatggagtcatcacctgcattttagcaagagttccaggtgattcgtgtgcacattacagtttgaaaaatattggtaaatattatggtcatcatagcgggttatccaactactggttttagctctgccactatctaattgtgtgaccctttgccagtcagctcagcttttcaaactgtgtttcatggagctgtatccattcagtttattactcagaggctgggtagtaaggtcagcagctcccatctgagccctgagcgactccagttttattagtttttatctgttaggctttaacttaagacactgtttgaagaaaaggtttgcctgtgaaagagatcgaaggcctactgtctctgatgagtcttaaagtcatttcctgatctgaattttctatgattataatatcattcattgataggaattgtttccttagcgaaaaggaaaaatctcttcatttctatacatgtggcaggttgacatttgtcaggtactgaggctgacagacagtttagctacctttaggaggttccttgatcaaaatagagaaactttgccagccactgaacttctcactgttttcctcatcttagcgacttaatccaggcctcaccccatctgtcactacagaagaactgtttacgagacctcactttactagcttttatttattttatcagtgttggttatttgggagcaaactgaccctgagctatcctttggccagtgccattcactttgcatacattgatctaaaaaggcaattgggttccgaggtctgagatacccaatgatattctacatgtgacaaagacatttccagtcctgcacaccctggtaacctaaagaaggccaagcatctcaattaattttcagttgacagtttctgcagctgagtccccaagtcagagtccctaaacaaaattgtttgcattctataggaaaataggacacattattagcccagttctaaatccagttccatctttcctcaaacaacagcaaatgttcttctcagattcatagcatggagcatcatccacttttaatgttttccatccacatagctgcattgccctgttacttatttacaaatttattggctttagatggcatattttctccaaagaactcaggcagttgaatgagttgttttagaagtctacaaaatatacccttactcattcacctgtgggatttacatgaggttatttcacattcctcttcatgtattgcgatggggttgttataaagatactcacacctttaaatcttcccagtagcacgtatatttctgctttcaaacacaacaaccaagaaaaaagaaaattctactgaaacaactgaccaatcttctttccttagaaaaatcaatctcatcagtagctcatgaaattcaatttccctggtcaggaacaaagcagataatcatcccctaataatatttatggatgacagaaatgcagagcaaataaaattagcctctaaaactatcatcaagttccttgaaacttttttctttatctcaaggggatttatggagtaatggtaagtgtgtttttctccatttctatttaggccaacacacatcagaggcactcaatagatatctggtgaatgaatgaggagtgagtaaatgaataaagtaaaatacagatgaccctcaatttggacataatgcattcctagagactgcttcataaaggatattgcttaaaggcaaaacaccgactgcaagaatgccaccacttttgtctgtaaaattcattacaaattgacagcagataaagtagcatatatatctcttcattaggtaacagcaaataaatggaaaggcaaaagagggccacaatgaagcatgaacaatgtatagaattctagtaaaagatgattgcataaggacatttttaccttgcttctctttatgaaagtgtccatcaatatgaagaaaaagaagggaagaaccaccatcttctccatgacagcatgcctaaagctagtctaatcttctctctgtcttgaaaggttttatggatcctgtgagtctgcttatcacagtcatttgaagagagaaacaacaactgccaatcatgaaacagaggatgtgtgagatatgggcttgctgtgaaccaagatgatccaaaggggatgctgaaagcttagcagaaccaaatactcaaatagaaaaaatgtggctgatttgcttcaacagctttccgagataatataccaaagtggaaactgatagcttctccagatcatacttgctcattctgtccccgattcttgggcagaactctggtctagagagaactttccttattccaagaagcaccgtgagcagaagacctaaaacaagacccatagagtaaagggacatgggaaacaaaatggcaaatctgacatcagaaaaaaatgaagaagaaaataaataaaaaatatagccttcatacttttaagtaaaatgagtgtaagctagttgcaaaagacataaaattaataaaagataacaacttaataaaagatatcaaatctaatctgtctctctcacatgcacagacacacacacacacacacacacacacacacacacacaaagtgttgaaaggataatcaggcaggccgattttaagaaataaatgtaaaaataaagtcatcaaaaactgtcaccgcattaagaacctaaaggattaagaaagacaacatagaaaatagcatccatgagcatagaaggcttgaaataatcacagaaaaagaaatgaaacaaaaaaattagaaagcgattagatacaatattatagatatggaagtcagacatagaagatacaaattatgatataaattatagtctaaaaagagaaaaatataacacaggaaaatttaaaatatttgttaaaataacatctcctgaaatcaactaaaaccagaatcttaatgttaaaaaaaggtctattgtgttttaggaaaattttatgtgaaacatctcctgatgaatagaaagtctgtggccatccaagcagaaaaatcaagctagtctaaaattcttcatggcagaattgaatgccagaacacagaggaaaaattgtataattatagatactattatccaaggtttttttttttttttttttttgagatggagtctcgctctgtcgcccaggctggagtgcagtggcgcaatctcggctcactgcaagctccgcttcccgggttcacgccattctcctgcctcagcctcccgagtagctgggactacaggcgcccgccaccgcgcccggctaattttttgtattttttttttttttgagacggagtctcgctctgtcacccaggctggagtgcagtggcgggatctcggctcactgcaagctccgcctcccgggttcacgccattctcctgcctcagcctcccaagtagctgggactacaggcgcccgccactacacccggctaatttttttttttgtatttttagtagagacggggtttcaccgttttagccgggatggtctcgatctcctgacctcatgatccgcccgcctcggcctcccaaagtgctgggattacaggcgtgagccaccgcgcccggcctatccaaggtttttatacccagtcaagctgttcttcaatgtaaaggctatatactaataagcaatctaggctataacacccatgatccttcaaaaaacaaacaaacaaaaaaaccagctgatgaaagaacctaaccatagaagataaatcaaagaactctgggttagagaactcattgaattggtattgaatctatatatacttagagataggactaaaaaaacactctgggaattatgataatagaaatataaatattacaaatgtattactgcatctttatattttatttttcaataattatataatcagcaactgggggaagcagttaagactttaagtttggggagaaatgatgcctctgattggtctttttggggtgtattaatccattcttaagctgctgataaagacataacagactgggcaatttacaaaataaagagaggtttaatagacttacagttccacgtggctggggaggcctcacaatcacggcagaaggcaaggaggagcaagtcacgtcttacatggatggcagcaggcaaagagagagaacttgtgcagggaaactcctctttgtaaaactgtcagatctcctgagacccattcactctcatgagaacagcatggaaaaaacttgccaccatgattcaattacctcccgctgagttcctcctacaacacatgggatttcaagatgagatttgagtaggcacatgcagccaaaccatattgggggtgtcttaggttaggttctctcgaaacagatcctgagacaggaatttgggtaccatggttattgagtgagtgctccttagaggaaggatgtggataaacaggatggggagacgttaaatgaagatgtggtctcagcttgagtccagcttcagtctgatcccatagagagttctggagcataaattgaaccacagtgctagccccattttgaggtgaggggctggacttttgttccctcctttcaatcagtcattgactgcaggctgttcaatagggaagggataaataggggtgtaactttagagctagatggctcgacttccatgctgggtaattccctgaaaaagagacagctgggggctttagcaccagcacccacagcagcaggggtctgggtgcatcagtctgtgaaagcgaatcttggcagtttcccaatggtgtctcctgtagagcattgatagctctggttgatgttagctttccctgtcactgactggtcctttgttatcctttattatggcttataaatgtcagttttcagtgtctgaatgcatttcactgagagaaggaaagaaaagaggcgctgtagagggaaaaggaagtggggaaaagcctagactttttttaaggagaggaaatgtgccagtgagctttgtggaagttgtttcagcatggagcagttatacatgttgccagatgtggagtctcaacaatctcagagggtcagcctctttagctatgaagtgttgctttatgccctccagaaattatccctctctcccctccacctgctgctcatcccatcccccttttctctctactcaccctaatgatccatctcacaagagatggcatgtctcaaatggcaagaacaggaagtgacaaacatagacagtgttggtaatatcgaaatgaaaagaaataattgtctctgattaagatgagactagaaagacattgacattgctctttgtagcatgtactagggagcacccaaatctctaagagaggactaaagtgtggcattttgcaaacttactttacaattgtacccattgtctgttgactattcagtgggaataacattctacaaaaacattctttagcaaatgtggatgtaggcaatgagatccagggggttttcaagaaatacaggtgaagatgacatttgtgctttagcaataactcttaaagaaatgtggaggatgggttagagaggaaacagaatgtcagggaggccagtgagggctatttcagtagtctaagtaaaaatattaaagtcctgaactaatcttagtagttattaaagcaacctcccagataacgcaggatcccatatccctgacagaagagccactgatgcttctgtgtccatgaaacagctaataaaaactgatgtttgagcctaagcattaagaatgttttcctgatagggagctaaaataatctttgaaaatcacacccaaaatattagtcctgccctttgaagctatgcagaacaggttgcttgttcactaagaaaaagatgtatatatcaagtgctgtcttacaagtgggaatacaaaggtgaggaaggcatagccgtagctctcaaggagctgaatatctagtgagaagaaaaagacatactcaagttttgttgcaataaatttcagcagaggaaagctatagggattttagaggaagaggtgaatgactgtccaggcatgctaagaggattcatggtgcctttatgaaataatccttctgatataggagggaaggaatcaagtccatcctacccctacctcctgtttgtttgtttctcagtttgcccagttcttgaacttgttcttttattacatgaatctaaatttcattgaatcccattccttcttcctctggagattttgtacttttccaatgtttttctttaaatgtaggcttccaatcattggtcattgtctcagctgtgatctgaggaacgtagaattcagcatagtgtgctgggaagtggcaatgtacccaaaatgtgtgtggaaggcttgccagtatattagcaataccttccctctaccctttgagttctccttagaggtttaactcactttctaagcctccagaaactgtatcctatgttcctttatattgtattagaaataaagaattggttaaactcaaaataaatagatgttagtgcattaacacaagcctgtacccattataaaaatgtatttggcaaagaaggtaatgtttaacccaaagaaatatcctttagggaagggattttaggcaccttaatgtaaaatacacatttggtaaagaggccctcttcagtacacttgagtcacaccatatattcaatttctgacttcataagaggctaggtcctgataaaaatattgaaggaacacatgtgttaaaagtgtagtataacatctactattattggatgctacataaaaagcatggagctaagcaattctccatgtattatgatcatgcaatttcaacaaccactctataagatatatgctattatctccattttacagatgaggaaactgaggcttagaagtattgttcgagatcgagtgaaagaggcctagttttcagatcaagaaatttgattccagttttgattttatcacttactgtgattttcgcacaagtcatgttactatgtttaaccttttgtttctcacctgtaaaatgaaggaagatgactaaaccatttcttggggctgttccagttgtatgattttatgaacatctccatgaaagtatctttatttagcaaatagccaaatctgagaaaaaggcaaatttattagtctttctagaactctttagcatcctacctttaccatgaagcattactccacattggctggcctgtattctttccaactcctaaacagtagctcttctttcaaatgtctccctctatttaggcacaagcaaggtgctgaaaagcatgagaaatatgagcataatacaaggaaatcgataaggttaggaatcttcacacgtttaacttaatcatatcagacactgaaaacaaagtcatattttattgccaaagagaaatgctctttggcaaaccatgatagtaatctgattgtgaacaatgcttattcatcatttctggggcactggctgctgtgccagccaaggggacagctgacctaatgggcttgaagttgcattcctcaacattagttatgttgttgtgtgcaatcaccaacacaaagatagtgtacattggtcaatcagaaaatatgggctccttgcttgtttcccgttctgtttttattgacgattgggggataaattgcacagtgatagccaagagcataaattttctttgtacttttatataatcttgtttctcattttacaatatctgtatttattcctaaagttgagaagaggatcagacattacaaaacaatctggaaaaggtatggtaataatctaaaatatcccatagaaaacacctttatgtgttgccctaggtcactgaggcagttataacaaaaaatactatagactggatggtttaaagaaaaaaacagttatttcttgcagttctggagactgggaagtccaagctcaagatatggcagatttagtgcctggtgagaacctgcttcctggttcatagaagtctgtcttcttactgtgtcctcgcatgatggaaggaatgagagagccctcttgggtctcttttataagagcactaatcccatttatgaagtctctaccctcattacctaatcacctccccaaagcccccatctcctggtaccatcactttggtaagggtttcaacatataaattagggtgggggatacaaatatttagttaattacatgtgtatttatgtctcagagatgaggaggtcttagtttcaaatagttacacctatgcaattatcattccaaacttaacttttcctgtaatcctctccttttgatgtcataccatttgtacactgtgtaaacagttactctgggacatagtccataatttacactcccttttccttaattttactttgaggttccttctcagggcttcctttggactctgtggttacctctatcataactcttatcacatagaatgagatataattatggttgtgagatcaatctttagacgagagtttattgattgtttgtgactagctttgtgttaaatgtggggtcactaaatcctgcatacacttcttttcaaccaggtattgtttcaataattccctctatctctctataaaaaattgaattccttaaacccgggagtccttatggatcagagcaagtgagcagcacatcgcattctaccaatttagcttttttacagaatcccagtccaaatgggactattccgtaatgttctgtggtcgtaactgttgtccagtgtgattggcctggttttcttaggcatgaaacatgatgtattaattatgatctgaacagtgagccagaagttactgtatctagtttgacagtattaacatttatggcacatagttaaacaaggacttttgattctgaggtaggaggagttgggaagatatgagcagaatttttatacacgggggattctgattagaggatcaacaattacaaagtatagttatgcaccgtttaatgacagagatatgttctgagaaatgtgttgttaggcgattttgtcattatgcaaacatcacagagtatacatacacaaacctagatggtatagcccactacacacctaggttatatggtacagcctattgctcctaagatacaaacctgtacagcatgttactgtactgaatactgtaggcaattgtagcacaatgataagcacgtatataaacatatctgaacatagaaaagaaatagtcaaaacattgtgttataatcttatgggactaccgtcatatatatggtttgattttgtccaaaacgtctttctgagacacatgactgttgtctcacacaataaagagatagaaccttcataaatggagagtggagtgtcaatgcaaagtgggattaaatcaggaacttacttgaagacggaaagaggaggaacaccttcagcaccatctctcccatccttatcccaaaacactgatgactttacagccacctcccatacacactgcaagcacagggcactgcaagaagctgtggttacagaggagacactgcctaagggatcagtctgagtgccactggtatcttatggaaatacaagccagggactatcatagtcaatggaagaggattcgtgttaatgtcccacagtcagccagaagtgcttgtgactctatgcataggcacagtgcctttgaaaattgactttcaatcactttgtgagagtgaacactgttactgcagggtctagctgctccacccattgttctagatgggagataaaacagcctaactctagctggatgctcagtccaaactctaggatgagggtcaaggcagggactgcactattcattcatgtttgcttttctgggactcctataactgatgccttggatttgtgggatggttggttatgaccagtggctacacctgaggaactcactgtagcttgatggttcatatagatttgagattaccaaaatgttattcaacattcatactagatggtcttgaatatacttcaaattcagcatgttctcatctgaactcacatctcaacatcaccacactgtccctttcctttttcttatattttcagagtatcagtataaatctcattgcaccaggcagaatctgaggagaaatccttgcagctccttcttcctgattcatcatcaaagcctactgattttgcctccaaaccattcacttctgttcctctttacatatggacaatgggaggaactgactaaccacttgggcttgtcattctgtttgacccctttccccagatgtattctttgtcctctgccctattctgccttgaccttgacttatgccctccaagtgggtctggctgagaaataactggcaagagatgagcattgggaaggggagataggaaaatatttatctccatctcttgctttgtcagctcttctggttgctactgcccctacctgccaggctttggtaaactgcccctctccttgtcccttcaagctatgatgtggtgcgccaatggctgagtcttcctttttgactcctgaattttgctcatatctgtgttagtgactcctttgctacattttctttaggccaaccactttttttcttgaagaacgctggacaacccactatttttcccatactcatgttgcccacttcaaaactgctcttcatcctctagagagtggtcttttaaagggtaaatttgaccatcacttttctgattaaaactctccaaggggatcttgttgatcttaatattgacagaaatagctctaatgtggcccacagcctgtatgagctgactcctgtctgcttctccattgtcatctcttgtcacagtcactgggttccagccatgttgctcttttattgttccttgaaattgccatgggacctccagttttgaaggtcttctttaattcttctgttttcagaaattctctgctcctttcttgcctcctcccatccctagcctgcaattttataggaagtgttacattcctttttaaaaatttttattttaaattcagtggtagatgtgcaggatgtgcaggtttgttccataggtaaatgtgtgtcaggggggtttgttgtacagattatttcatcacacaggtattaagcctagtgtccattagttgtttttcctgatcctctccctcctccctccctctgtcctctgataggccctgttgtgtgttgttctcctctatgtgtccatgtgttctcatcatttagctcccacttacaagtgagaacatgtggtatttggttttctgttcctttaatttgctaaggatgatggcctccagctccatctatgtccctgcaaagaacatgatctcattcctttttttatggctgcacagtaggaaatgttacattcttagagaaaatcttcctcttcatgacactttatgacatttctgccacaggagtttgattctatagttaatatgttctcataacaccttatatctttgctccaaagcatttatgatggagtataattacatagaattgtttcattgatataaaataagttccagtgtgtgtggaaggatgttctgtgccttgtttttcattttatctgtaacaatttgcacaacttgtggcaaatgattatcattttataatagttattgggtaaataattaaaaagtatctctagctaaggccaaccaggacagcaaaaataaaactaaaatgaagagcacttgaatgagacagcaacagcagtgaaagtagccttccatgattattatcgaaatatctgttgggagttaagctgaaaactgacttgaggagtttgggaataaacatagcccacagtcagaggaaggggctcattcaaaaacatttagttgctctcaggtcaacgataggtctcaaattccatttttcacgagcatccacaataaaacctcagagcacaagccaataactcaagtactcaaatgccctccagggttccttccaagttgctctgctgacctgagctcattacttttatataatgattgcagcagaagcatctatggaagtactgtctacaatgagatagtcaaaaaaatactaaggagataattacagtattaattcttaagttttgcagaattaattaaacataaaaaatattattttggaacatcaagtttggatatatggtgacaaaacaaaaccactgctggccagtgagaacttctagggaatctatattatacatttttacattatgtgaatttgcataagtaaattatccagaataatttactcatgtcaattaacagaaaaaaaaacatgacttaattaaaatctcattacaggaactctcttcaatcaataattttggaaagtgacagacaaagatggtccacagggggatacatgaggacaaacatagctttagataagactgtgtttgcaccctagactggaatgtctcttcctcaaacatgtattaagccattccatttactgagcacctcttatattctaagaactgtacttgtcatcgtggtgggggaagggaggcataaataagctgtgatacttgggacaggacaaccaaaacctagtttccttcaaataggacttgagtcactcatagaagtctttcctaaatattccggtcttcaagaatttctctgaagacttctaaaaagtactgcttatgtcacgtgtgaatcctttcttgatgatgatgatgatagagaagtatttattatgaaagaaagaaagagaaggagagagagaaagaattgacatgagccaattcccaaaataaatcttttatatatatatgtatatatctctccctatatatatctatgtataccatatatatatatttatatgttacagataaaatgaatacatatatatgtattcatatatatatttatatgttacagataaaatgaatacatatatatatatacctatacacacatatctcctattggttctgtttctcttgagaaccccgattgatacatagatagaagagtgtatgtaaaacggaagcaaatagatcttcatggaagatcagttgggtatgaaagcaaagagctatgaaaagtatatgatgcttatttgcttattgttacttgtacagattttgatatgtattattgtaatgattacttttatgtcaacatgactgaactaagggatgctcatatatcttgtgaaacactatttctgggtgtctgtgaggatgtttctggaagagactagcatatgaatgggtagacagcatcaagaagattgccctccccattgtgggtaggcgtcatctaatccactgaggggcgaaatagaacaaagaggctgaggaagggagaatttgctttccgtttgaaacatccatcttctcctgcctgtagacgtgggtgctcccagttctcaggtttttagactcggatcaaaatatatgccatcatttctctcaattctcaggccttcagactcagactgagttacaccaccagctttcctagttctccagcttgcagagagcagactgtgggactccttggcctcccataactgcacgagccaattcccataataaatctccatatatatatatatatatatatatatatatatatatatatacacacacacacacacacacagatacacaccatatatatctctctatatatatgtataccatatatatatgtatatatacacacatattctcttgagaacccagactgatatatagatagcagagtgtatgaaacgtatgcacagtctataaattatatagtaatcacctatctacccacttacctacccactacccaggtaaagaattagaatatggccagtgtcttagaaactttctgtatgtctgtcctcgattacattctgttttatcccaccctccagaagtactcaccatcctgtttttaggttaattacttcattgcttatacttatgatattatcaacagtgtaaatgttttcaaataatatgtggattagttttgaaatttgaatagctgtgtaagaaaagagcaatattgccactattacacaatgcctcccaagagaagagaaatagaagtctgagaaatctcatggtcccaacttcatggaaagtttacatggatgagtctcctctaggcatgtcagaggccccactcagaccacgtggtggggttaaggtgtgtaccatgtactggatatccagcagggatatgatcaggggtattctctgcttctggactcatcgttccctacctacagctctcagagtgggtcaaagctgaacatttctgtgaagcaaattgagtgtcttcagctgattcaggaagcatggcagagtggacaggatatttattagcacattgacaagacaaagtcagaccagctactattgagaatcatgcttaccaaggaattttattctctggtaaaaagttggtatgaggtgtatgtatcatggcattgggcatcttagcgtgtataactttcagtgcatctgactcttggggtgcattggtccaaactctgggttgcccttgaatggggggaactctgtccttctgatataacattttatggtgctccatagattctcacatcctttctcctatgttgaatgacctgcttcctatgtcttgttctttgttggcttattattaagtattattattattactattatcgtagagctcatatttgagtcacttcttaagaaaggaaaaggagtgaacaatgagaacacatggacacagggaggggaacaacacacactggggcctgttgggtggtggggtaggcagagagagagcattaggaaaaatagctagtgcctggtgggcttaatacctaggtgatgggttaataggtgcagcaaaccactatggcacacgtttacctgtgcaacaaacctgcacatcctgcccatgtactcctgaactaaaaataaaaattaaaaaaaaagaaatgataagagggaagtgaatttttgaatcttgaatgtttgaaaatatctttattgaaatatcatattaattgctagtttgcccgggtttagacttttagatcagaaataattttccttcaaaatttcaaaggcatttttcaatgtttcctttcagggttattgttgagaaacctgatgccatcccaatcctcaattccttatcccctcatttgaagcttatagaattgtgatttcactgtgctggaagctcactaggtcctttacatctaaaaactcttgtcattcacttctaggaacttcttttgaaatattacagtggtaattttctcctttctcactgctgtgatatctctttctagaacatctgttatttggatatgggatgttctacatactttgttctactttacagtatattctcttaactttatcttacaactcttcaattgatattttcattttatttcctgcttattatttgaatttctaagaactcattcaaaatgatgggaatatttttcttatgtgttattctctttttgtttcatgtctgcattaccctatccctctgagactatgaatcatagctttatgttcctttttttggtcttcttttggcatggtctctattttctcctagttcctctttgttctgtttgtcctttgggtctctgtattctattttagagtggcttctttatcttagaggctttcctttaactctgatatccagtaaacctaggtacctgttcatgattaagaatgaactactcagaggtttatttgaagctctcattgtctggtatgttgtcaactttcagattcgcaagaggagaatgctccagtgtctttggtaatttttccttgtgctgctcagatttcccagaaaaccctcccactcttcctcctgtaacagcagaaatctgactgccagagcaactgtcttggagattaaacagtcagcattatttttacatagttacttatttcctttgttttcagtatggtgcccacaccctcaactgtgcttgatgtccctagaaaccttctgttttgctttttactttttttttttaagggaatacgtatcaacaattttatggtgcagcaaacatcttttagagtcatggagttgaagagaatggcaactagtggtctacctgattcttagatggcttcacccaaatatctgttactttgacctcttccttccctttatctgcctctcctggttccaaacatgactgggatgcccccttctggggccccttgaggatttgaggattctgtggtgtaacttgtgttggttttcaattttctttgatactgacttgtaatttaactttctcggctctatcaagttacttcttatccacttgcttttggcttctaaaatttggctgctgttgtcttcttttctttcttcccatttgcaagagtttgtttctacaaaaaaaaacattgtttataatgaatttagtgggtttcatggggaaacaaaattaatgtatgtgtttaacctgtcatcttaaccagtaactcggctggtgtagttttaatgttaagctttcacctatttaacacatatttcttgatctctgtggagtgaagaagaacatcatctcgcctccataaattctaagacaattacttttggcatcatttagataccctttccttattaagtttaggatagtcaagctttcaagcactaaaagtgctgggtaataatggtaattagccaaattgggaaaataaggccatctctctacctcgtaatttccttttttccctctaggtttagcagtacaatttgaattaagacaaattcagatgttctctaaacatattaatcccattgcacccccaaattatacactttttcttcttctaatgttaaaatagttactaaaccagcgaatgttccttaaccacacttatgctacgagccccttatccaaacattctctcagtttggatgatttcacctcctgaatatctcctgcattttttccttttgtattttccctgctgcaaatctctcaaacctacctctttgattgctgtcagacagtttttttttctgaattacaaatatgaccatgtcactttcttttttaactcccaaatgaatctgtattgctttaataaagtctaaacttagagcagcatcaaaagctgtcaaagatgccctaactgccctcgtattttcaacctcatttttcaccatggctttcctgggtgcagcacttcagtaagaacacatgcaggtgtgtgtatccatggcagactccaggcaatttcatactgctgtgcccttacacatgctgctctctctgcttggagcatcctccttgtgctgtctcctctggtgacatccttcaaaaccaggttggatgcctctaggaatctctcaccagccctcttgaggttgggctcagagccccttctttacccatggagagtcctctgcattggtgcatcctgcatcgacatggtttgcctgagcttccatgccctcttggagccccatgattttattcctcatgtcttgcatgctgcctgacagtgtagaatgtttcctactgtgagaatattgaatctgagggctgccaacagatgaatcttttcccttagaggaatgttttacccatttccataattatttcagccatttagatttaaaattcactcactggcctaggattaaggtaactttagtgtattccttttttttctttccttctttctttctttttctttttctttttttttttttttgagacgtagtctcgctctgtcaccccggctggagtgcagtggtgccatctcagctcactgcaacctctgtctcccgggttcacaccattctcctgcctcagcctcctgagtagctgggactacaggcgcccgctaccatgcccagctaattttttgtatttttagtagagacaggttttcaccgtgttagccaggatggtctcgatctcctgaccttgtgatccacctgtctcggcctcttaaagggctgggattacaggtgtgagccaccatgcttggccaactttggtctgttcttcatgagctgtttaatttctctgggcctcagctatgtcattttaatcattatttgtttagattcatataatttaactctagcattgtcatctttctcaaaatccttctgtcttttcctgatacttgtccctccagccccatacatccttttctggtgtttcctacataaagtttgctgctagcaagctctcaataagttcacccaagttttagctaataatttcaaatacactcccaaatggatttgcattactagaaagagttctggatgcttgaaaagtcttataactccaaagattaaagcttcctatggatgggagatttcatagtgctcattaaggatattgggtgaaggggctctactctggatcttctcctcccaccacctaaataactgtaccacatgcctttaggagggtgtgtgtgtgtgttacagaacatggtctccaattcttttgcttttatttccagccaatgagctcagggatgtgagttggatagaaacagtcggctagactaccgtgagatctgaaggataggtgtttattttagtacgtttattcagagaatagcaggcacctaggaaggaaaaccgattacagagataaaaagcagttaggatctctcggaaggataggaattcatgtgcattcagaaagaaaaaaaaacagttgttcttgtgtgtgtaaggaaaatcatctctgtggaaataggttgtttacgttttcaagtcggcaaattcccttcacagccacaccacgtatcaaatagagaagggagacttttttttttggtccctggtgtgcacaaggaggatcccttgagatgcatcctcgtggagcaggaaagatcataatagcaataatgacaacaatgcatcaattgttctcaaaggcatctatggggcagagtatgcttttcaaaggacattcacttctattccatcccatttgatcattatgacaaccgcaggagggagataagatgggtttcattatcaccatttcacaagtaagcatcctgagatggggacaatgtagagttatttttctggaatcacagagctagctagtggcagctttggagccagagcccagttttttctaagaatttctgtcacataaatggattatgtgtactgcatgaacacagaaatgcccaggatgtggagaaagcccaaacctctctcttacttggaagtctggatcagtggttctgggaattcgcagatttgcctggcagttctcttaagaggacacagaaaggccaactgggaaatcccttaacactagttcattgataccttgactatcttagccaggagaattggtgtttttattttccctggctagctgttgggtttgtaaatctccagagataaattaaggatttgttcagtggccttgaatgaatcatgaattgtttcataattgtttctttatgcaaagaagagcagaagggagtattagtggcctggttctttggacggtgtgtctactgacctggtatccaagggatgtgtttgctctgcttgatgaacagagaagaaagaagaggaaaggaaagcaatgctcagctcttccatgtaacacagactactctgcatttgttatcccatcagctcagaatgttaggtggcaagggttttggagatctagtgcaaacccctcactcagagaagggaattgagactcacagagctgaagtgtccacctaaagtccagggaaccagttaacaacaaagctgagactggaataaaaaagccaataggactagtttctagctaccattttcttagaatctcctttgtgcttgctacagtgatgcacacttgtgtatctgttgctctattgtttcttacattccccaaaattgagtcctattattccagtgttttagtgagggtaagttaggctagtttgaggtaacaaagtagcactgcaatctcagaatcattaatataacatagatttatttattgttcttgctactaatttagcgtagattagtgggtgacagatgcagcatgtatggaagtgcttcttcttgtcactgccaccaaaggacccagactgagagaatgtccaacttgcagtaggtgcacccgagagcacacatctctgggtttgctggggcaaaagaagagaattcccttctctgtcgttaggcccataagagcttcacatcgctttttctcatagccccttgatcagattagtcacacatacccatccaactgccaaagagctgagaagtcactgtcttcctgtccttcaaaggagatgaggacagacactgaggaacctgagagatgacagccactttgatcttcttgcttctactcataacctttaattgccacatagcagacaaagtgatgtttttaaaataaaaattgtattttatatatataaatatatttataattatgttatattacatgttttatttataactgtatattacatataaattatatttataattatacacataactattgatacaatatattaaaaatatattataaacacataattacatatatacaattatatataacttctaggaaaagtaaattcatatatatacatacacacacatatatatatacataaattcattattatttcacagctctgatggaagttccttccgactgtatttccttcctatcatcttaagataaaagacaagccactgtgccataaggcctctaggcctgtgtggcctggccttttctattctcatgcttcagtcccctaaacgtgtgctgtagcaggcatgctttcttccagttcttgcatattccaagtgctttctttgctcaggttcttgacccctgctttctttttgcttggctaattcttatgcagctttcacgtttcagcttcagtgtcatctctgacctgctctacgttccatgcacgtagagagcatgggtattttgttctccattatagattcagcacatcatactgcacctggcacaaagaatatactcaataaatatttgtttatattaattaacaaattaataaatatttgttaaatgattacacgcaagaatgaatgatcagaggcctcccatatacagcactatatgtagtcttctaaagcacattgacatagccataacagataaatcagtcacttagaacagcaaccatttatattcttttatattcttagcaatattattatgataaagatgcccacattgcaggtaatgataattccaagtgttcgcaattcatcacctgcctactggacattttcagcatacaacatattattatttttagtattaaagtacataataggaatggaaatctaaggtttgagtaacaggaaatgtgcaacatattttcaaagacagataccaccaattcagcctctctcatgagaccaatggagtgatattttccaaataaggtatcaaatgcaaagtgacaaaggatttttgcatcatttccaaatgtggaccagtacttaagaagagtagttttaactccctacattgacatagctaaggcaatttgatggttcggaaggacaatggcatggaatatgtataattagaactgtcatggagaatctgagacagattgttgtcatctagtcagatctcaacagaagaaaagtgattggaagcctgatatacctattttaaaaggtacaatgagtggtataattaaaaaggttgggtataagcttgacgaagttagcagatactcattaaaaccatttcagtaattcctataataatactggccatggttttaaagtcacctagtgaaagtcattatattgaaataattaaagaaaaacttcatattgtgtttccttggcaatagaacattcagatggagccacactaaatatttttctatttattgcagccatctccttaatgacacttttcagcacatattatacattaaaattgtttatgatattttgttattgctgaatttgatttaattacatcagggcttaaggaaaaggagtctaaactgagagagttcatgaagacttcgttttctaacagtttagcgaaaggtctttcaattcccttgcctctgcttatacgcctcctgctccccactcctaaaaccatacataaaatggtattgtccaatctcttcttagtcttaccttcactaaaggctgtgaactgccttcagaaatatactcgtaaaacttacacagactctcattaggaagctgctaccctccactcccgtcacagcttaactccaatctctttggtcttttaaataccttgtttcctctccatctttaagagacaaatagatatatctttcaagaatgtttcaaatgagaactcataactttcttgagggaattctcttgcccacttggaaaatagcttctctggcaggggttgtgatttccgatgggggcgaagtcacggcttttcgcaactactctgtatttttgttttaaatgtacaggaatctcttctaaagttcagatatagacttatactcccctgacatactcggggggtctggatattttcggaggttgaagcattcatattccatccagtggtttgtatgaaagtagagtcagcgtgatcaacactggacactgggaggtgactcttggacagccaaacctctcctttctgtgccagcttcccccttaggaagaccctactataccattgtcaggaattccggaattccatactcccttcctcaaaacccccctttttcctgaaatccactctcaggaaaacaggtaagctcctttcaatatacaaatgaatcatcagatcttatactctagctttcctgcagatatttgagtaattgcagaaggctaagctttaagttaaagaagttaatctttgtcatttataatagaaaaaaaataaaagcaaatgactaacagggaagaaattaagtaagttattacttatacctgatggcatgttaccaaagcacattgacagaaagtttaaatttttttcctataaaattattaaacatttaaaacttgtagaatattaatggcaaaacatgcttatgccatatgttgagcaaacacaggaggaaagagtataatacgataaaaactatttaaaatgtcacagaaaaagactagaagtgaatagttgcttttgagtaatgggattatggtttttattttaatttaaaacatccctttattattttttgtaacagggaaaaatgtaagtgtaaaataaagaatggattctcaatgggagattttttttaaaaaaccagtttctgcttgaatatatatacatacagttttttttctttctttctttccttttttttttttttttgagatggagtctcactctgtctccaaggctggagtgcagtggcgcgatcttggctcactgcaacctccacttcccgggttccagtgattcttctaccttaacctcctgagtagctggtatgacaggcatgtgtcaccatgcctggctaatttttgtatttacagtagagatggggtttcaccatgttggccaggctggtctcgaactcctgacctcagttgatccacaagtcccagtctcccaaagtgctgggattacaggcatgagccaccgtgcctggccgaatatctttatctactaacacctacactccttatttggtggggaatggcataccagttctccccacatgctttccagaaggctgattgagtggaacacttggagctgatgacttggatttacataagtctcatcttactaacacatcaaggcttttggatttaaacctcttcagcatcctctgtatccctaaggaatgcagtttctgcccctcttatccctgagtatagaggagaataaagctttggcatcaaatcgccttcagttgtggttgaatccaccatttgctagccgtgtgaccctgggtgtctacttaggcaaggaagacaagctttcttatctgtaaggtggtaatctggtgaaataaaaatgagaaaatctatgttaaaaaattcttagcacagattctcaaacacgaatagttacttaatatctcatgactcattattgcactatgcctccaaaactgaatgtgcctcatagtgtgggttttatcaagattgggatctgcctctcatttcttaggatgagatctttcttaggaatacctgtggctctatttcctccttccccaatcatgcctgaaaccttggattggcaaagtcctgcttcattcaaataagccctgggtttgctcaagagaacagtggcttatcttttccaagttaatagaatacaatttaaattacgttttcaccacaaagactgagttaatcctgctagaggctttttccatttcctgaccaatacgatttggcactggaggagactatggtatgttaataacagtattaattgttaaaattcacttgttacaaagttttcattgtcttggtatcattataattttccttttataaggagaatcgacttaaatcacttggctgctctttgttcttcctgtttgctaagcactggcgacgtcttgttttcagcacttaactgagtgcacatctcagctctcacctaaagcctttgccaaggggctaatttccaacattgacagcatcctccactcctgcgtccctgaagcaaagctaaagaaaaagtaggaaatagcaagagggaagaagtaatttccttcacttctttctgagtctgttcattccttcttggaattcagttgagggttaactgtcttctcctttcctgcgaatgcttcacgccgcctcctggtgaccaaataaagccatactttttttgctgtctttggaaatattcttcatggctcctgtgggctgtgggagcaggaagccaacaaaagataaggtctcaaatctcttcaaacagtcctcacacttgctctgctgccaagtcattaagcaagcaaactcctctcccatacgggctgttaacttttatttgtgtagtgctgcttttaaacatggctggcctgaactcttttttttttttctccttgtattgagaagaaactgcccagcatctgctttgatcactgcaatgtctgctagtctactagacttttggcctatctcagatgactctttgaatgtagcttgttttttttgttgttggtggtggtggtggttgtttttgtttgtttgtttagcctcattcatgtattcattcattcaggattcatttttctaattcaacaaatttattttaatcagctagtatttgaccattctagatgttaggtatatatcagggaatatagcagttaaaaaaaaaaaagaaaaaatccttgcccttctaaagctcactgtccagtaggggaagggagctatgcaagttactgcatatagtgtgccataatgtggttaagtgctttggggaaaaagtagaacagggtaaagaagatcagaagaatcaatgggagaggtctatcattttaaatgaagtggtcaggatgggttccattgagaagtgaatgtgagtcaagactcaaggaactgcaggcatgagccaaaaagccccacgaggcaagaacgcttcagatcctgtgggaggaaaccaagacatagaagcttttgttcatattcttggcagtatgagtcattgggggaacacagactaataaagtatgtttcttgccttcaaagagtttatagtctaatataagaaacaggtccaaaataggcaatttcagtagactgtgattgataaaacacttggctaaggatgctttaggggcataaaatggtctgaagaaggtgatattgttaatggcttctctttgtcagcatttgttaaatggccttttgtagagtatagaccactaattacagaaaataagagtcattggggggactcaaatttgtttagcaaggtctatataagttaaatgatataataatatattaaaatttatacattaagcgtaataattaagtgctcaatttattgattatatttatataagctactacatagcaatatattattaatttatatttagattgtctcaataggattaattcatagattgattattttaatgtatggattatgtaaatgtagttcattatgtttatgtcaatatattaaatttttttttttgaggcagagtcttgctctgtcaccacactgcagtgcagtggcgagatcttggctcactgcaacctccgccttctgggttcaagagattctcctgcctcagcctcccaagtagctgggattacaggcgcccgccaccatgcccagctaatttttgtatatttagtagagacggggtttcatcatgttggccaggatggtctggatctcttgacctcgtgatccgcccacttcagccttccaaattgctgagattacaggtgtgagccactatgccaggctctcaatatattaaaatatttgttaagtaatatgaaattaatgtattttgtaaattaaatcattaaataattgataatgagattttgtgtatttaattacattttatataagttaataaattttaaatattataattaatttcactttcattttaactacttttacagtggccactagaaaatttgaaattacacatgtggctgacactttatttctatttgtcagcactggtcttgattcactgaacagatggctggcttcctagttccttacctcttagcattccagaatgaacaaggttaccccaggtcactgagggacactgttgaggagaaaaagttggattcattgagatcaacatacaatgtctttccaactgccttaccttcttcttagtaacctgatgagtacttctcatgcaggggatttagataaaactttcttagactttctgtgtgaactgttagcaggtacatgaatttatgtgattcttcattctttttgcaaaaaaacagtctaagttttacccactctataaagtctgttctctatttttcagccgcttgtggtgttcatttaccattcaacacaggttaagcactgctactgctgattattataataattattattttgcgatagttttggttttacctgcaagaaaactcagtctagttttggatttctttataccgcaacccatggagcaaatgttactcatgtaaaactctcaatgagtgtcttttatctttgctgctgccatttcattacctgggacatttgtgccttgaattgtgtatgaaattctactttaaaacagattcctggtttatatactcatattgatggtctctattttattccttggaagcagttctgtgttctgtttcctctgtccccacccacactatacagttctatcattccattcttgagagtcataattcagcattcccccctgtatcagtccattttttcattgatataaaaatacctgagactgagtaacttattaaaaaaaaagagttgtaattggctcacagttctgcagaccgtgcaggaagcatgatgctggcatctgcttctggggaggtctcagaaagcttccaatcatggcagaaggtgaagggggagcaggtacatgacttggtgttgaaagcaagagcaagtggggaggtaccacacagttttaaatgaccagatctcatgagaactcactcactattgctaggacagtaccaagagggatggtgccaaaccattcacgaaaaaatcatgatccaatcagcctctgaccaggccccacctccaacactggggataacatttcaatgtgagatttgggcagggatagatagccaaactatattactcatgcagccaaacaccctcgctggtcaatctccttacagtgggcctgaagctctgaaatgtttttctggtctgaagattttgaatcttcccttgacagaacagtcaagccatactactcaattttaaagtggctggtgacatccgtatctcctaaggcaaagtgttctagttaatgatttgccacttctgctaggtgtgcacacttaattgaggctctgtatgagtctgatgctgagattagaagtccaaaagtcaccagaaattattacctggcataacctcgttttcttaattacaaagaaaaattaaatatcttctttccttggctaacaaaatagagaatgtatgtgggccataggcctgggaaatttaagatgtgatctgtctgttggattttattcttattctgatccccagacttctcactaaggagagagaagtccatttattagctctggaaggcaacatgattctgtggtaaaagcatggattttagagtcagatacattttaaatcccagcttcattgcacacagctgtgtatcagccccgcatcatgtgtgtgcggtagcacaaggccccatcaaaacaggcagtgcccctgtggtttaatgccctgcagttgctgctttgagattcttcataattttactttcgaatttgtggttcataagtgaagcccaatgggacgctggagcaagccctgggtcgctggccttctcacctcctgctacttccacccctccagggaaccactttgctgctcctccactcctgcccagtcacggctgctgctgctgcccctgcagggtctggatgcaggcatgggaggcatcggggttggcacctgctcccagggagtgtgacattaaatagcaaacaaaagcacaccatgcaggtcaagagggagaccacagaagaaaagaaatagctttttttttttcctttttccataaagcagctgcattttgattttgtcctgggcatcacaaattttgtagctgaccctagctgtacaactctaggaatgttccttagccatttgattttctgtgtatccatcagagtaatggttcaagcagaaaagcaccctaagatatgcctgtgtgtatgtgtttataaatatataaatatttgtgtggatgtgtacttatgcatatatgtgagtccagtgcatacataggtgacataagacttcagagattgtttaactgcttacaacaatagtagtatacctttaccagcacagggcagaatggctgtaagaacttcaaggttgctgaacctgtcactgtggaagagtgtagaaatggaccactgggcagatattccctctttaggggagcacagctactgccacactttgacccagcaggggtgggctggtgattgcattcaccgacttttctcctctgattctctcacctcatgctggtgccttcttctgatagaaaaaggaccagcagccccactgcagggaccacagttgacgtggtccctggaggccagccttccagggatggagtggggtgaggaggttggctagtagatctgtagggcaaataaagaatgcccagctcacctttagcagggttgctttgaagattacataagatgaaataagtaaaaccctttataactggaaagacagaggcatctattattaccgttaagatgattcatctctatggagaaactggagcaagtttgagttcaggtagtgggattggaagagtaaagaaagttctgcggcattcctgattccgtcatagcaccatgctcagaaatggtgatgtcatgttaaggtacaaaataaaattccagtgacacagcctcaaaattagtaacacagagatgggggtgttgcgacatctgggttctcattctggctctgacacctttctgcagaacaatcacacaagtcacttgcctcctctcctcccctccttactcgtctttgagaagggcgggctagttacaggctgcttgtgaggattggagagatatctagaaactgctctgatacaagccacagcttttatgagcgagtcttttcctgggccaagcatggaaatctaggttggtgggtctctgaagcagttggttgtccctaaacagcgacttcatttccggagctactttttaagtgttggtgaaaacacaaataactggagactgtgaagtcttttagcgccgggacctgtggggcagtaacctccaacaggtagagtgaaatgacatcctttctctccacgcctgagtgttcctatggcaccagttgcttgtaatgggtgaagaaaaaattgaactcgtttctcctgagacacacatacgaaagctgactctaagaaagaaaaactgaaatgtggaccatcttatttagttccagttaaagagagatgtgtttaaagcactctgatgtgtggccttaaaaaaggatggggctgcctcttaaggcggaatcacacgagcacatagaaataaaaatcaaagcagttatcatatttaattttcttactgactagattcattttgcattagcaggggatggcgaaggagagggactgggaatgcattatgttcttatttgggtcatttccttgtgctttggggaactttctcttgtcagcgtgcacatgcatgccgggggtgggcgtgagctggccccatgcactcactggcttctttctcggtgtcgtatgacccaggagggagtctgcagcatggggtgattctccacatagagagtcattcaccactctcaaccccgtctccaggtacttcctgtgttcatttgagaagaggcagctgacttaaagcctcatttctaagcagactattagaaaacatgtccgcataacctggagcggcagctcacgcctatagtcccagcattttgggatgccaaggtgggcagatcacgtggtcaggagttcaagaccagcctggccaacattgggaaaccctgtctctactaaaaatacaaaaattatctgggcatagtggtgcacacctgtagtcccagctactcaggaggcaagggcaggagaatcacttgaacccaggaggcggaggttgcagtgagctgagattgtgccactgcactccagcctgggcgacagagtgagactgtgtgtcaacaaaaaaaaaaaaaaaaaaaaaagagagagagaaataaataaaaaagaaaacatgtgggtacaaacaggaagagagagggcgagaggggcatcctggttggagacagctggactcacacatgcactttgtagccactcaccataaaggcagccccaaaggctctgagagctggagggggtgtaagagatcctatcctggaaagctcccatttcatacacaggcagacagcctgtgaggtgaatggggtgacgtggggctggaagagaagggcaagggtcaaaggaaagcattttacctcctttagaaaccatcatgcccccaaacctaaaacttagggaccaccgctgccttcatccatttgtcacctaattctctaatattccagtcttagtatcttttgagcccattttattcttgccctgtctattgccactgccttagcttctggcctccctcatttttcatttaaatgactgcaagtcttcaccctcagctttctaaaatgcaggtccggagactttactgttcttgctatatttcctcaacattcccacaccattctcaagacaaatcccaagggtgtgagcataggacaaagggccctctccatgatttaactggcttttaagactccagttgcaccacattacatatttgccaggcacagttctaagttctttacaaatgttagatcatttactcctcaaataaccttgggtgatgtgtatttttattgtctctacagaggagaaaactgagacacagagaggttcagtgattttccaaaggtcacacagccagtaaggagcagggctgggacttcgaccagacatctgctggcagagtcggtgcttttagccctggcacctgctggtgtggagtgctctgtatgaatcagacccttcctcacctctggcactgtacacaggctgtttcctcactttgaagcaacctttgctcctttctttgcctgagcatattctgtttgtttttccagattcacctcaagtaccacacagtgtctttcataaaacaagaccctgtcttacttggtttctgtgacacattataccagattgaaattactgattaatttgtctgtgtttccccagacaacctgtgtgtctctcaaggttagggacagtttctacctttctctcacttgcaactgaatcatgggggcacggaatgaaggatggtgcaaatggtctttcaattcttgtctctgactgttcagatcagacgagttacttatctctgagatgctttttataatagaggtaaacagagttcttcctacagcacagctattgtgaaaagcaagttaaatgatgactataaacccatagccctggtctggcacataatagatacaccacaaagccccctctgttgagtcagtctggtgtccttgcaatccatcctccactacactcatttttttctaagctcatttctccatctggactcatgcttgctatcaaggatgatctccccacttctaccatcacaattataaaaattcaaatccacctgtccactaagccttccttaactgtgtagctcgctttggtctctccctgtttcctaaaacatattctcagtgtcaacattctctggaatggtccccatcatgcccgctgcccccctgcctgaaaattttgactgtggatttatgtctcttatattctcaatgaggttgtatcctctcaagtgatcaaggctataatttttatttctttaccatatttacaactctaggagaatgacacgtgttctccaaatagtaaatacttgcagagctaaagtgaattgaagtgaattcctttcccaggtactttgctgcctcctagtgttgtggtgaggctccaggctgagagaagtttcctctgagctccagctcagccagcacccttctgagtgatgaacactgttgcagaccatagacctgagacagctggctgcggtttgacacagtttagaagatgctactacatcagaggcctctcttgtccattgggtcccttgtagtggacccctttgctttactcctgaactgagtatcagtagggcatctgtgcagggcttttaaagacttctttcctctctcaaatacctcccttcttcccagtttctgacctggttactgtttggagtttttaattccctctgatcttaaggttatattgcagttcatgttaacattcaaatactattgagaaaaataaaacataaattttccagttatctagattgtaaatgaatttatgatcctgacgagaaaaaggcatgaaaggtacccactctatgaaaaagtaaaatggggccacgttaatgagacagaaagcacaagaagcagaaagccttgtgtatgtcatagattaaccagaagttgtttcggctaggtaccggcagagacaacatggtacagtggaaggaacatggattttggtgtaaacactgaattcaaatcccagctttttcagctgttagctctgtggtgtgttaagtctctcagatcctcagttttgttgccagtgcagtagggcagcgatgcgtagctcagagtgtgtcatgaggattggatgagacaatatatgccaaggcaattaatacgatgctaaggggtttgtgtttttgaaatgcaaagagtttagttttgtattgattcccattacaagtttgctcctgtattttccggctgtctagtccattcacacatcttcatctcttagggaaaagacatggtgtctttaatgttctctgaattagcacagtgcctggcacttagggttgtagtaacaattatggaataaacgtaatgcctacagctaaagatgctgaaactctgtgactttccattatacattcttttttctttctctttttcttttttttttagaccaagtcttactcttattgcccaggttgcagtgcagtggccccaacttggatcactgcaacctccgtctcccaggttcaagcaattctcatgcctcagcctcccgagtagctgggattacaagtgtccaccaacacacctggctaatttttttatttttagtagagatggggtttcaccatgttggccaggatggtctcgaactcctgacctcaggtgatccacccaccttcgcctcccaaagtgctggaattacaggcgtgagccactgcaccttgcccattatacattctttctattctcagtttttatctttaatattttagagtcggagactaatgactcccacatcagcaccccaattaaatagactttttcctgtttatcacctttcctttaatttcctcattcaaagcattattcagttgtcctctcctcttgctgcttaagcctctcaccagctctcagtcaatgctcccagatgcagctttcattgcatgtgatgttgtttaatttcacttgtcttatctataatcacatcaagccatttatttgttaataggctgtttggtggcttcacagttggaattgctgtacatcacatttcatttccacaaggacatcctttatgccggtctgccttatgtggcattcgtctcttcctcttgccaggctgggccagcttctcccgctgtaccttccacatcagctgttcattttccccctgctgctgtcactgataatttccaggttaaatcttataagtggaaattggatccacagctggagttgaaacgcagctccttggagttattaccacagtctgttcccgggtaggtgggaaagttgaagatgatagatttccagtgcctgggaataacaatgctgtccctctaaccacaactaaggtgagattactttcccctggggagagcgatatttttaccttttcactctgagtttacatcagggggattcaagagaggcgagtggtttttcagtagttttctgttattttatgagagatgagttaaagtgataatgtaggctggacagcaaataagttataagtgattgaccagccttttaggctgtcagctatctcaaatagaggctttctttatttttttttccacagtagaaacatttgatttatttgattcaaacagtagaagtatgagaggatcaaataaataggtttgttcaagaaaaaaaaatattttagtatttcatgctttcaaagcctatgccataacctttgaattattcagcaataattaattcaacaactatttactgagcagcttccactgtttcaggattggaaatatcagcgcaatagatcacacaagattccatctttttgaagctgggcttctagtggacaagactgataataacaagacaagatacataagatgatttccaatgtactaggaagaaaagaaaacaggaaaatgtgagaccatcttgggtgagatcatcaggaacaacttttcataggagagttgatgttagtgaatccataattgctaaaggagatttgagtaattaaaaggggtccgggttgatctatatctctatttcttttctctccatcccatgctttcctctctgacccaccccagcccctagtaaccatcctgaggtcagaaatatcaagataccttaaggggctttctccttaagatgtcaacaacatccactgaggactgaatagaagatgccagcgcttggctcaggtgcaggggatggcaagagctgagctctgggctgtgaggagttctggttctggtctggcctcatcactggggctgtgtcaccttgggcaggtcttgccccctttctgggccttagccttcattttcatttgtgaagtcagtgtgatcagatgatgtatgaaatttcagaatcgtatagaagataacctacctattaccttaaacagtccgcgtgggaggagaaggtagcaatagttgacatgaggttgtgagggatcaaaatgaggctctcagtgctaccctacacccctcaactttgtcacactgaatctgacctggaaggtacatgtagggacagtttcttatagagaacacactatctaataagtggagacatggcatgtcctcaaaacatctcccttattgcccattccgggctttaacatctgccccttccaattactttgactcttcaaaggttttcagtgcaccttaaatggtttgtacatcttctgcccccttggatacaacagcatgcacggacatttgcttttctgattaatccctttgctaccaccctcaactcaaagcattacaggtaggaaaatggactcaaagatatacaggttaataaagagaagaggggaagagccaggagcacaagcagtgtccacgggctgctggtcccagccagtgagtgagcaaacataatggacctgggcatcgaggttgggagaatgctgaaaaagaaatgccaaagtcaatttaagccatgttatcctatttcctgggattggtgctgggtactgaacagaggctctcagccaacccctacctcacccagagcacagtatagagtatagacactgtcttgtacacactcagaatacaatagtgatgtgtttctgtgtgcagccctggactgtgtgaagtggcttctcctggacatgtcaactctccttgcttgtggcaggacatcaaaattggttagactgaaagtgtctaatgagctactcccatatgccaagcaccattttcagcaacagggactcagcagtgaacaagactggcaagatctccaccttcaagggtcttatattgtagtggggaagacaggaaaaaataggcacataaagaaaagcaaatcaatacatttcagttgctgatgaagaatgtaatgtggataagaaataactgtatgggtatttgtgttgctttaccctgcatgattgggaaagtctctctgagggatagatatttgagttcattcattcaacagagataattaagtaccttctatgctgcaggcccttttctaggcagaaaggattcattaatgaataaaccaaacagccccatacacagggagccttctttcagcaagaagagacaaagaaaaaatatttaaagtgtaattttttataataggtataataaacttcatatttaatgatgtataactgatatataggaacagtaatcattcttattgctttattgagcaatgcacatcatatataagtgtagttgtaacccaaatactaagagggtggagccacttaaagatttggataaagcacgtcccaagaagaacatagtatcctcaaggcacaagtaacatcctatgtgatggaacacttgggccaggaaggcatggatgggaagataagaggttgaagagagagccaggagccagatcatcaagccttgatttcatccaagtttcaagggaaaagcctgggaaagttttaaggagatggcagaaggaattggagagatctgatttaaggtttagaagattctctctggcagttggtggagcatcaacttagggacaagaagggcagcagggagatgggtgagggagctgctacagaggtctagaagagagagggtggtgacttgaactagggctgtagcaggagaaacagtgatacatagatgatacatatatatatatatatatatatatatatatatataggcaaataatagatgatagatgagtaaatagataatagatagatagaaataggtagatagatagatgtagacctgacagcgtaactactgaattggttgtaggatgggaaggaaaaggagaaattaaggttttcccctaggtttggcctgaagagttgggtgaatgttggggccatttatagagagaaggaagactttgtgggtagtgaagagggaatttggaggacacaagtaaataaatagctcagtgtgagccttttacagtttgactttatacagtatgcaaatgaggatgtgaagtaaatagatatgagactacagttttgaggagtggggctggtatttggaaggcatcagtggtgaaatggcatttaagctagggggaggatgagagcaactaaagaaagtgtatacatagagaagaggtttgaagactgagttctgggacattttcagatttggaggtctaatagatgatggagtcccagcaaaggagggcaagaaagagtggattttgacagaggaagaaaactgagtgtagcatagtaaaattctagattcatgggaaatgttgctgaaaaggtaagatgacagagaattaaacattttccttgagaagggatacagttaccgattacctttaaagagtgtggtggaggaccaaaaccaactggagtggggtgaggagaaaaaatagaaattagggagtgtcaacagatagcaaagacagcttttttttttttttttttttaagaattttgcttagaagtagagaaaagtgctatttgttggatctctagttggagtcaagagttaaaataaattatagaacaatatgtaatcataaagaggtgagaaaagtgtggatgaatgctgtggcttcctttttctctctagtagtagtccctagttggtctgcaatgaacttttgcaagaacgagagtggggaagactcttcatgaggctgataggctgtagctctcatggtttgtctttaacccacaggtagtgagcaagccatttgctctcagggaaaatgtggctttcctgacagccccagatgatccatctgtctctgcagcctataggtggggcatattggaaacaaagcatttaataaaatgtaatagttgtgactcgggacatagaagaggcagattgaaagagaagtggagaccaacacgccatctttccacataaatggcttcagaaagctgcagactcagagtggatttgttcgtgcaatcctcacctctcctactagttaacaagtcggcaagccagcagtgagggtttggtttgtaccctcagttattaaccattagtatttgtgtcatgtgcttttgcctgggaaggtgtccagagattggagagtagtgttcagtcttcagtgggtagaaattgatcaactgtagaaagaaataagttatcatggatatgtacatcagctgtgtcttgtttctaatggctcggctcgcgactagctgaaacaatgaaaggaaaaagtgtgggtaattttcaagtaattgatgtatttggggctcatgtaggccacaatcatgatagtcacctaatttgatccttatctcagagccaaatcttctcacagagttgttgacatgggatgtattttgatcttgattttggagtcttgaattctttttccaaatgttcattcttctccctctgtatgtccctcagcactagattttatcatcaggcacagaacatctttctgagtaatctcttccatactccaggtggcgaattaaaaactatgtgaggatgactggaagtaaaacatttaggcagtacttgctgctctggagacattcaaagaacaataaacacttctaatgtagtatttactgacctccagaagtgatagctgatagtgaagacagagtgcccgggcgctccaggctattgctccatgttgagattggctgagaggtcttcggaagtcctcagattgaatggtagtttcactttaaaccaagcaaaaattgtcatcaaaattcatgactctctcctaccccagctttcctccaactaattgggctctctttctggtcttgaatgcatcgagtttttatttgtctcagtgcctttgcactttctgctctctctactacaaagcccttcccagggccctacacatagttggttagcacattctcgtctttctggcatcaacttaaataccgtccccataaggagatagtctttgaacaatcaatttaaagtaatccatccatgccttttattttctttatgacacttatctcaactttgttcattttgtgtctcttccatcaaacaaaaagctcctctaaagcagaaattttcatccttcctgctctatgctgagtgcccagcccaatggcagacacagctgacactcagtaaatatttgttaaacaaaatggcaagtgtgagtgctgtagagtattatatgtttaaatattaatttcaaagatttttaagacttttgttgacttcttcaacacattctcctcccatgctataagcatctgggggctcttttccacctcttccctctcccatcacaatgtctgacacataacagatactaaacaaatatttgtggtatccatgagtgattccaattaatttgtattgggtatttcaatatagtcataagtacatctccatgtccaagtatatctccatgcccaagtatatctccatgtccgagtacatccccatgtccaaatacatctccatgtcgacatacgtgtccatgtacaagtacattcaagtacatccccatgtcccacatacacctgaggataccgaagcttagtgtggtgggcagaataatgccccttcctcatagatgtctataccctagtccctgggacctgtgcacattgccttgtatggaaaagggattttgcagatgtgactcaggtaaggatcctgaaatggggggattatcctggattgtactgttaggtacaatataatcacaagagtccccgcatgagggaagcaggaaggtcagaacctgagaagaggcagaggtcagagtgatgcagttgctccctggaggacacaagtgaaagaatgtgaacaacccctagaagtcagaaaaggcaaagaaatgaattcccccttagagattccagaaggaatgaaatcttagtgacattttgattttagcccactgaaatccattttggacttctgaccttcagagctgtagataatacatttgtggcattttaagcactaattttgtggtaatttgtcacataagcaacaggaaactcatacacttagttcctcacattgaaccctacccactctagctctctcgccatccctgttccctattagctagattccccaattcacacacctggaatctccagagagggagttctagagtgtgggactctcccaccaatctgtgtggatcatgagtaggtagatcagagatccatggaaggccatcaagaccatcagtggttggagtaggtcatgaacgtgatagggccttgagggtgagtagttactcctctcccaatttggtaaagaataaacttcttccaggaaaatcacagatattgtcatagactgcaagaagaaaaaaagcaaaaaaaaaaaaaaaaaaaaacaaaggaaggaaagaagaaggaaaggacagagagaattatgactgtgttgtgtctttctctgatacacactcctggagcttctccaagcctgtacttgccttctatgccatatgcaaatgctgtagaatgatttctttcagtgctaactttatttaattctatcatcatggtttttactttaggaaattttggttccaatagtttaagaataacatggaactgaccttagaaattgtctaatccatattgtgactggcattatgaaaaagctattattggtgaaccatggactgccctgtgggagttgggaggagaaggagggcagaggggcagagtggaagaggagaagcattcacagatgaattcaaggtctttgcataaatgtgaggtttcttaccactataattttttttaaataaaattaaagaagcaagcaagcaaacaaaacaaagagaagatggttcctgaggacaggtgttttatctaagacatgttggatgcccaggatctccttattaggacttaggatattaggccacagaaaccaaagatttgtgagggagaagttggggaccagtgtcaggtagtcaggcctttgctggtaggaagatggggcttacataccctatagccacacaggcttggcactggtcctgggtgaggagagagtggggcccaggtataggccagccaggcttccccagatgatgcgtctgtactttccagtctcactctgctcccctcaccacctctccacacaagcctcagttctcagtcactaagcagcattgagaggcaattacagggtgcagaactctgcccgggctcctggaagaaaagaatatgtgccatactgtgctaatgcaggctcttctatcatgcctctaataaatgggttcaataaataaatgggttctataaatgggtccacaagcgtatgtttgattcactatacttcatgttgtcattttcgctggctccttggggagaagtctcatgcttcagggaaaggcacgattcaccagaagccccacctcaaacttcctttttgtttttgtttttaaaaatgaacttttgtgttctcacagctccatccagcagggaatcctaaggaagctctgaggagagccacagcaccccctttctcctgcctgggtgtctcctgtccctccacaccagctccgtccgctcctttagtttggaatatttccttaacagacctgtaggctctgcctccctactccctcctaagccctcatccgcaatccacatgtctgacctctccaaatagattactagttcagttggttgctggacatcttagctctcttgctatccatatgatattggacaaggagaaagacagggtttttctttgttttttgtttaaggagaaaagtgatataaatgcccctagtccttgtcaagttttatgttattatcctttcctcaaaatagagcacacatgcacacaccacatacacataccacatacatctgcacacatgtgcacataaacacccacacacgtacacaccacatacacatacacacacgacacaccacaaatacatgtgcacacatatacagaaagtttttgctgtagatatgtcattcctttagcaactattttacactttttggagtcttctctcactattagaaagagctttgcggtttacttttagagaaaaaatccacctcctcctttagcatctagtcatcagttgggagacagtttttttttttcccaattagaaggaaaaaaattccaagtctattttagaaaagaaataaatattctctttctcaaaatgcattttcagccaaaatatgccatctgggggatgttagaaatttcagtcagtttatctttataaactattgaagctgcacctgttataaatggcctctgacacaaaacattctagaaacttcgaaaacaacattgaacatgacttcttgactacagatttaaacttatttcatcatacgtgcttcacagacagtgagctataaggtgtttaattagggcacagcagtcatttaatttagcagttaaataacttcaactaagataacgggttaattttgaggagagtgataaactccactccctaggtcttgttttattggactatggggcttagcccttagcactggattggcttgggaatttatttactgatgaattcaaccaatattacaggtacttttttaaaggcagtcagctgaaagttggaggaaattctgtttcagattctaagaaaataaacaaatctgctcaccttccactctatgctaccttttctattttgagagaataaacctctaaatctttagacttttatgaagaacacttaccatcatttgaatgtctctcttcatttccagtctattctgaaagtatcttcctcccaccactaggctttagtaaatatttataacccaatcatctcaagtccattggactccatcactggtatgtttcaattatttaaagtcagaatagcatcttctgggcagctaatgacgtctcaatagatatacattatcgaaacatattgttatttacttaataaatcaagcctgttggggaaagtagatgcaattcaagtaccagaaatgaggaataatgatggcatagatcatttctgaatcactctagcccattttacagcctgtaaagtacactgaattccataaaagtgacaaatggtacaacattgtaataaatagctatagtttgtgcattgtgaattggagcttagattcatattgaaactctctgtcaaaaaagaagaagatgaattaagtattaaaatcatactctgtaaaaggaattatatattttccatttatcttgatttattatatgacatcatgtgcttaagtatatgtaacctttccaaattgagttgatttaatgtgaagggaaaaaatgttaaaaaagaaaatttggtgtatgtttagaattttctttattttcctgctatatttttataaaacttttaactgttccatggaagcttaatcatattacattttttaagttgaattcccagaaatatgcaataacatctacagggcttattaagaacaaatgtgctaaatcacaattaatatgactgtttttcattcaaatttcaacgtttgcatattaagaacacataaaactggctgggcgcagtggctcacgcctgtaatcccagtactttgggaggccaaggcgggcggatcataaggtcaagagatggagaccatcctggccaacatggtgaaaccccatctttactaaaaacacaaaaattagctggacatggtggccggcacctgtagtcctagctacttggaaggctgagacaagagaatcacttgaacctgggaggcagaggttgcagtgcactgagatggtgccactgcactccagcctggtgacagagcaagactccatctcaaaaaaaaaaaaaaaattccaaaactttcagtgaaatattagctgtatgaagagagtgactacgctgaagggtgaatctagacttccaaaatgacagaccgaggaatgggcatgccttgaatttttccaaatttcctggaatttaagtgatacatctaccgttctatttatcattgaaaaataattcttagaggaataagcacatgtaaacaatattctattgacatctgctatttactccctcaagttaacaatacagccacaaaatgattaagatgaacaaacccaactcttactgcattgcttcctaaggagatgaagtggtttttcttaggcatgtgcattggctccattttttttaaagttggtttgcagcacacttcaggaggccagaagctaaacaagcaagtgtgagcgttagcctgtaggaaagacaaaggcacaaagtgaggaaaagaaatgtgtcttggtcaccctcacctttcccggtgtccaactgacattacaccatctctctgtcctctgctcatctgcctcttgcatgttgcattcttgaagctttcctctgtcattttgctaatttctgggatggagctcgcagctcacccgctgggatagcaggagaatgggtgtgaagtatcaagggctgggttggccacaatgtcctccttcgccttccagcaatcgattcctttgtgctccattttttccaagtgtatcaaatggatccaacgctgtcctgtgcggagtaaaagaggtattctaatgatattctaatggtattcaaatgatattctaatgggaggtgtaattttatgaatacttcttgcatctcatctccacaattaaagcataaattttttggtttgaattctgtcaacagagactattcactaggccccttctctacacaaggctaagttgctatatatgtcctattttatataattatctaaccaagcagaaacgtaaatatatatcttcatttagcttatgaaggaaataatttccaagctcactaagaccatagcagaggagaaagactcaagaccatggttgtctgatggcaaagcacctactcttccccctatttcatattgattctcattaacaactaaggttatttagaaactatatattccatgatataaggtacccggcagatcacaggccttcataaaagttttaagttaataaatcaaccactgagggaaaaggttttttctctgaagtcctgggttttccactggtaccaaggtattaatagtatcttatacatagtagacataagggaaaggaaaatagaggagaaaaggaaaaaaaattggggagaaatgaggtagatgagtgaaggaagatgaatgaaaagaaagacaaaaggcaaagcagggaaggagaaagaatatctcaggaacgatttctgttccaaccattgataaactggtacaaggagtctactgctctcaggctgtggtgcactgtttgttttgtttttgaaattataatgaaagaagagagagatttaaagatcttcactcaccagaaaagttttgtctcctttcatccattaataattttatttaatttcaatcacttagagtggtgtggactaaggatgctcttattgccttcagggaacactgcagaggcctggaatgagttatataagcaatatacaagcaaatgtcaagtgtaagcctcctctaagctcagtggggcctcgtgatggaggttatagcaagaatggctgtgagcctctggttcaagaagggctaatcctggctgtgttcctgttctgccaagacaggaactctgtcactatctccttagccttagtggactagagcattagctcttgtattttcttttgcacaacagctgctgggcttctcttttaggcctcaaaatgcctggtatagtgcgtgacatgaaataagtcctcagcaaatacctattggattggattgattaagtgggaaagaatggagtaatggctttgtcttaccacattgcccacctgatctgttctttctttttgtcccaagcacttaaagcattcttattgagtcatggtgacaagctactctctggataaggcttcttgaaatggattttagtcaagcttagcaccaacggccattaggaagccaacaacacaacacatttctcctctgtacttcgcagattatttagtgaactcagccatgcttcccttggaggagtgaaaacagacatggaaactggggtgaggcacacagcgcagcatacttctgtcctggtgtggacctctgcatgaagaaatgtgatgtgctaaataaattcctatccccaggaggcttgtcttcttatctcagacctgccacctataaactacgtgacttcctggtgttataatttactcttcttgtgccacagattccttgtatttaaagtggatatttgctaagtgtctgctatgggtcaggtgcagtgctaggcacacatggacacttaactcatagaatagattcattcattcattcattcattcattcaatgtatattattaagtacctccctctgtgttccagacactattctggttactagaaatactgcaatgaacaaaacagataaaaataaaatatctttacccttatgggggtggatgtctataattcagacatatgagaaatggactctgtgttcagtagccatgaatactaaagagaaagagaaagcaggcgagggagacacaattttcaggggttcaggttcaattatcagaagcgttttttccttatctcttgtctttagatagcctgcttgggagacaattcactgagcaaaccatgccactgtcaggaagaacattctgggctcagggaccagcaagagcaaaggagctcagccatattaacgactgtgccaggatattttactacacagtgaaaaacactgtttaaaataatgaggcattatcacagaaaaagaaatgatcacatttaaaaaaataaatttgtatgtagaaataattttatatgtgcaagaaagttgcaaagagagtgcagagagttctcacatgctcctcgacatcttcttttcattagcattttgcgttatcatggtgtatttgtcaaaacggagaaaccaactaaattatgatcctgctggtttctccactaatgtcctttttctgttccaagatctaatccataatacaaaattatattcaggaaagtccattttaaacttaggtgttaagttttatttttaattctgattgaatgctatttccgtgtaccaggtagcagttgaaaggcagttggcaaatacttgttaggccaccaagtctcccttaagtgagtcacacacagcaggaagaacaccaggcaggtggtctagagtcctgggtcttcatcccagctcttcctcaaccaaacatgtgtccttggacaagttttcctctggagctgaggcagatttcttctgtacaaaatttagaaatttaggttagatttgtaagatccctccaacctcttaaattctgccctggcattatcatggcatcagtatcttcatactcagaagcatcaaaaattatgtgactgatttccctaatgccaaacgttggttcattacagcaccagagtgggctgagagagcttcagcacaacccttgcctctgactaccatactccactccaggctccctccttcctatctcccatcctccaacagctggctccagacagtaggtgttaacggctgagatcactaaatgaataggaactattcttagtattttacttgtatttcttataaacacccttatgaggcaggtacaatttttttggcttatctatcttggtagacagaataatagccccctaaagatgaccttgttgaaatcctctgaagctgtgagtatgctgtcttacaaatctcacatctgcaaagggattttgcagatgtgatcaaagtaaggatcttttttccttagttggagattagaatatggggagattatcctggggagatagggagttattctggtgggactgatataatcataagggttgttttaagagggaggcaagaagtcagagagcagaggagaggctacattgctgattttgaagatgaagcaaggggccataagccaaggaacgtatgaggcatctagaagctggaaaaggtaaggaaacagattctttcctagagtcaccagcctgtgacataataaaattacattttttaaagctactacatttgtagtagcatattggcatattggtttctacattagtagtaatttgttacaacctcaataagaaatcaatatgcccatgaaagttaaaagaatgtgtccagagctggaaggcattatcctcagcaaactaaggtggtaacagaaaaccaaacactgcatgttttccctcagaatgggcactgaacaatgagaactcacggacacaggaacgggaacaacacacactggggcctgtgggaggtcggggactggaggaagggagaacatcaggaaaaatagctaatgcatgctgggcttaatacttaagtgatgggttgatcggtgcagcaaaccactatgacagatgcttacctatgtaacaacctgtacatcctgcacatgtaccctggaacttaaaattaaaaaaaaagagagagagagatactgtaaaaaaaaaaaaaaaaaagtgtccaaaattgggtaactggtaagtggttcagtctagatttgagcataggccatactgcttcactaatgtaatgaaaaggccttccccatagttttttttcttttattgatacacactattttatatatttatgggggcacatgtgagtgttgcatgcatagaatgtatgatgatcaagtcagggtatttggggtatctaccactatgaatatttatcatttctatatgttggtataaagttctaacttctggttactttgaaataatcaaaatacgattgctgagtatagtcactcgtgaatggaactggaggtcattatgttaagtaaaataagccaggtctataggctttttgtgatgcttgaacgaagtacacagagaatgcaatgcttagaacacacaaatatcattgagttctgtagttaccacaacaatttgtggctctagtccacgatttctcaatcctgtcacactcacccacccatcccattatcgcctcaatcccgagcctctgtcctcggatctgacctgtttgacttttgtaagacgacaatcagaattacagtgtcaaaaatgacctcatgcaattgtacagcaacttatgctattcaccttgcataagtaaacgcgatcatatttagttttgagtcaaacatccttgggaatgagttaaagaatgattcgcctttgctgtaggtgtacctatccctctctcttgctctttctgttcatttgccttctgcattctacctattcttacatgtttgtctctgtatcaccaaatctattttggtcccttcacttcagcctatttcttgtttttgtagcagtccagaacaaagctacaatttattatttaatacataaatagaatttatgtgtttttaatataaagatcagaactgtaggaggttttatattttccttaaaactccaggcaaacaagatttttgactaaattgcttttttatatatgattctgctttttctcatcttatatgttaatagtcttgggtatgaaaagtacttaaatttagagacatggtaatttagagacagaggcctggtttagatatgctgactttttaacactgagaaagtctcttagagtccctgaagatgaaagtgtagattttagttactaattcacctcttgtgcttgttatccatatgaggagctggtaagggacaaatcctgcaagagtgagaaaaagcacccatttttctatttgctctacatttgggcttaaattgctgctaagtcattccccgagggaaatctggagtgagtgcatgttacaaataaacactcccaactttgctttccacagcctcagcattttcagctccataagagacgctctgaacaagcaaatgtgcttttaacttagctctaaaatatgtcctgataggtgggagctatttttaagacaacagcaaggacccggcagactgatatttgctggaacccaaattgcctcacatcttctctgactttgcccaacaatgaggcccatcaggttattattgtcccctgagaaaatatattttgcattgcactgtatgttactgctccccttaaagatgttggacatttttaagctgcgtaatgaggaagagaaagtgggtggcaggataaagaagtgggaaaatggtaaagagtcctgcatgagaaacaaagaaatctttgcaaagtgaaacaagagcaaaagagtaagataatttaaactagagtgataaatcacactcacacacacacacacgtgtgcacgcctatcaacctatcagccatctgttaatcaattatttattaattatctatgtagccatctatgtcaactgtcaatcaatgtatcatttatttatctgtcaatctatcatctaccatgtaggaggcaggagggagaatgctatatttgaactaaagcagaataaaatagtaaaactagtctctgtgtttcttttgtcaaagagggtgaatatgccatgaaagtctaatgggggatgagaagtttgtctccttctcttctttcctctcagcagcaccccctttcccacttcaagtcctcctcaaggccaggtgctatatattgaaaacagatttataaaaactattcaaaatattcctgagagaccaggtttgtcaccaaagacttcccaaatgataacaaatcattttgttatcatattctgaaaagcagaaaatgtggactggaagccaggaaacctggagtgtagtctgggtactatatctcactcaaagataaatgggaaagggcagttctccaacttcaatatcaccgtggggcccccaaatccaaccaacatatctagaagctgtctgactagatgttcgaatataactcaaaacaatccaacataagatcccttaggtaggagctttggcaatgtgtccacagtaggcagaatgatgggggaacttgaaattatgatatgaaaagtagatgaaggtggccgggcatggtggctcacgcctgtaatcccagcatgttgggaggccaaggcaggtggatcacgaggtcaggagatcgagaccatcctggctaatatggtgaaaccccgtctctactaaaaaaatacaaaaaaaaaaaattagccgggcgtggtggcgggcgcctgtagtcccagctactcagaaggctgaggcaggagaatgacatgaacccgggaggcggagcttgcagtgagcagagcttgcaccactgcactccagcctgggtgacagagtgagactctgtctcaaataaaaaaaaaaaaaaaaaaaaaaaagaaaagtagatgaaggaattagagatgtttatcctggaatagaaaaaattcatggatggactatataaactctgtgaaaggctgtcatgcacaggaggaatttgatttgtcctattctattgtaaactggtggttctgacacggcttccagggactcatctactggatcatagttagacccataagtaaaaatgactgctagctgtatactgcttaaataagaacagtttggggtgatacttgattttgtttggattcgtgcccccacccaaatctcatgttgaagtgtaatctccagtgctggagacggggcgtactgggaggtgatgggatcatggaggtggtgtctaatgggttagcaccatcctcctagtgctgttctcctgagagtgagtgaatgagtgagttatcgtgagatctggctgtttaaaagtgtggtgcctcctcactctctcttcctcctgctcctgccgtgtgaagtgctggcttcccttttgccttccaccatgattgtaagtttcctgaggccttcccagaagccaagcagatgctgtcatgcttcctggacagcctgtggaaccgtgagccaattaaacctctttttataaatcacccagtcttgcatatttctttatatcaatgagagaacagactaatacctttaacatacgtgtaatgccatcccctttctctcatgatatgccacttcatagagggcagacgccaccgctaaaacttatggagggaaccagaaagtggtagggtacgtctctacagaaaaatgtgctttctattgatgaaaattctgacaattaattgaattgctgtggtaggtagtaaactctgtcacttaaggtattcaagcagaggtttgaatgaactctctgtcactcaaggtattcaagcagaggttattaattaatataatacaatatttatactacatatattgtgtatatattctgtatatgtagtatataatatttatactacatatattgtgtatatattgtatatatatagtatataatacaatatttatactatatattgtgtacatattgtgtacatgtagtatataatatttatactacatatattgtgtatatattatgtatatgtagtatataatacaatatttataccacatatattgtgtatatgtagtacatatataatatatacagtatacatattgtattatattaatgaataaccactaccatccaaatctgtctctcacatacacaaacatgtatgcacaaggaagaaaataaacatcatgaaagggcagggatcctttctcattataaaaataacatcatcttttgtaaacaatttaactttcaaaagataatacagttggaagtaaccaaattgtgactctatagttaaatactttgaattgatctaataatatagaatgtaaggtgttacctagatgagtatgaaaacagaatgaagcaaactcaccaaaacatgaaataggccccccaaaataatacaacttgtttatgggaaagaaaacacattgtgaagtagacgaaaagatcgtatctatcattctataataatcaccaaaattaattcctcaaaatctcagagttggtagtggcatgaagataaataaatgcctattagaacatgaaaggttcagaaatatgagaaacatgatcagaagaggcagatctctccaccctattcaatctgtccagctcccgtgacatgtgctaaatgagaactattgtgtgagctttcagggaaaggagtaaacctacagcgaatgataaagtctccagatatttgaggttaatgaaggggaaggaggaggaaaaacaacatttgtggagaggctacatgtgccagccatcgtgataggcttttaaaatgtgatatttctcaaaactggtccatggggatgacactgttatctcttcttacagatgaagaaactgaagttgagtggtcatgctgagattcatatcacagcttttagaagcaaagcctgtgctctttctactctaccgttctcgagaatttaaagtcgtgtagaaaacacaggcgtggaacctataatatttaatggacaaacaagtgtattttactttttcatttagtctttgtttgtttgtttatttctgagacaaggtcttgctgtgttgtccgagactagagtgcaatggtgtgatcatagcccatcgcagacttcacctcctgggtctaatgatcctcccacctcagcctttcaagtagctaggactacaggcacatgccaccatgcccagctaatgtttccagtttttgtagagacagcatcttgcttatgttgtccaggctggtcttgaaatcctgaccacaagcaatattcccaccttggctttccaaaacattgtgactacaggcaagagccatcacacctggttatatttgtgtttcagaaattaagaaggtttgagaaaaaataaataaatgaaagatcttcatttggtcaagtccaaatgaagtcataacttacaggcatcttggagtgtgaacaaagagaaagcaccgatagttccacacaatcaaaaggggatttggaaagatgatcctgaaaaaaacacctgggcagggttctttataggtcactttgcagaacaagagaagtacaaggaaaagagaaagatatggtcccaagctatcaaacgacgaagcagaagataatccaaaagcaggtttctcagctcaggaaagcaagaacatgaacaatctcttcaaagggaaatagatcttgggccagctcacctagttcctgagttctagagagttttaagggctgctaggaaagctgtcttgatcttgttagggcactaccctggggagaaaacactcacatatggaagaaatgcaatagctaattcttgactaactgattgataggatgggaacaatgaagggaatgagggtgagaggcaactaatattaactaaaaagtaattgctgtcttttcatcaggagtctgctgcaaaggttgccttactgcaaacaaagtggctgaaaacagataatcctttgctaggacatctccacttttccaaaggatggaggcatcaaagaatgattactacatttgatcgtggtgaaagaggaatcatgactaataccaagagaggctcaagcagataaactgctgaaagaagtatggcattttattccaagtggatcagaaatatcctgttttatgcaatgatggggaagaaaatgaaagactcaggacatttctgggcaagggacagtggtgtcagtgagaaggggcagaccattttaccactttatattacccgcctcatgtgactagacccagtctgcaagcatcagcactgtgatccaataatctgttacaaaattcataggtttttccccctcccattcaaagttcccctgggaccccctatggaaagaaataggaagaggagagcaaaatctccctctctagcagggtcagcatccccgccctgcacagcgtcagcgccgcttgcccaccactctcctaaagacccgtcattatgaaaggaaaagagaagctaatggctgacttgatggaaacattcttggcactgtggacaggcctgcttggaggccctgtctgctgagccttgggaatgtgaagaggaaaggtagctggttaacattgtttaacacagaattaagtcataatcgcacctgaggcatattccagatctttgtccccccagcacctgtcacatttgatttaaagatttctcaaagtgaaaaatggtctccataagataaagacaactccccaatagcaaccgcaacacaaaactgctacttaccacgattttccagggaaacaaggaaaagggctagattatacagcaagcattatgtgagagaatgcaactctttttcttatacatttgaaaacattggagggaggcagtgaaagtttctccaagggctttactgggagaacatgaagtgctgggagacccaggatttccatgagtccattgggcagggcacagcgaggcaggctgcctatgtgggttatacctgctcttaagtaaggcaatggaaggtaacagaagccaagaaacaggatccataaactgaatagttctcactcctcaaagcccaactaaatagcaacagcagggagacgaaggggcttgaagaataaagatgaaaaatgcatgctccatttattagtatttgagttttcaaaagttgtatgaaaagatgggaagcaatgggacatttgatgacgctgaaaatggaaagtggggatttcatcggtaagagtgattggtgtgcaatttaggagagaaaaccgaagaagaaggaagcaaaagaaaaaaataaagacaggagacaaaagaatagctggcattagaggggaaggctgggctggcatgtcacaggatcatgttccctctatgttgagatgtgggtggctcagtctctggggattatattcataacctatatagaaaaataaggcaaagccaatcagaaagggcattaacctctggaagacgaggatgtggatgaactatatgctattattgtttggaagtaatgcatttgcacttcaactttaatgacagaggatgacaaaaattagaaaggtagtttctagtcttttccactatagtaaaggactgatttcttatagggaagtaatttctcctgacacattatattaggtaaagattgcatcttatatgaattaatacatttaaaaacaaagagaactattcacctttttttgatttgtttcagtttaaggggctaaaatctgttaatccgctactatgtgctgtctcctttggttattttatttgctcttaaccacaaatttggggtggtagtcttctgagattggtggaaaactcatgattttctcaaagtcatggtgttcatacaaacactcagaaatcaccctcattgggttcagggaaaggtaggcaatgtttcattccaagcctggccactggctgattatcatccccaccccctccacttattctgcctccagacaataaacttaaaggtgaaggcagggaaaggggaatgaagagttcaggaatatcagagatgcgtgatgaaataataacagatgaactggtgattatgatatcaaaagcaccactacaattgttcaggatgtaaaagaactaggataaagtaaaacttctttatcaacaaactgctggttacccccaatgtagagttataaaaaggaagagatggcagtgccaagatggtggtggtgggatatcaaagtcctaacagtaaataaatggcacattcagtgagcttaaattaagagagttatactgaatggactgtttacaaacatgtgggaagagttagaggataattaaacatccagggaccagtaatagtgagaaatccaatttttcaaggggcagagatattaaaaagtgattatcacatttgtttgtgtcactacctgtggtcttgaagagggaagaggagggaatcgtagtactggaatttaatgagagctattgcaccaggagaaaggtggctggaaaggagctacattcttagagggacacagtgaaaatctgtgcctggcaagaaggaagcctggggatggggtgaacaaatacccctatctctctgtctctctttgatccaaccttgtggttttcttacagggggacaagggactttgagtaaacagcccacagaaatcaccctctttgggtacaggacaaggtagggaagagtggagaaaaagtctggagtggcaagcaaacaaacaaacaaacaaaaactagcccacaggactgtgactgagctaattagcacaccactccttccaggccaccctacagaagccaacactaaacaaaaacacagcatctgctctgcaagacagactcaagatatgttctttggcatgtctttccaacaaaattactgcctctgggtcatcctgtgtagaaattctggagctaccaatgaattgggaagagtgttttttttttgtttgttttttgttttttcatagaaggatgagtaaagaaatttcacttgttttagacaagaggaaggcaagaagacatagttaatgggtacggcatggtaaaaggagtacagaaattaagaagagcaggcaaatagatgtgatggagaaaaatatatggtatgttatcaagaggaaagagacagagaacaacgaatcatgatttgggaataaagttggcaggactgcagaatggtgatatgtatgttttctccctcatctgtgcagcagctttcaacactgaattaggaaaaaatgtggatggtgatgtatattactttatttacacctcacagcaaccttgcgagataggttatccccatcttataaatagggaagttaagtaatttgtcaaagagcacacacttggtgatagggaaagccaggaaccaacctcgcttttgtttgtttgtttgtttgcgagttcccttggccaacaggccttcctgtagagaacattgggaggacatataaattgaaagcagagtggaggtggccagtatcacatacctgggacccaccggactcatgggcttccaataagagtaaccagaggggtccatagaaagtcagagctgctgccattgatgacgaggccggaggggctcttttttgccatactttcttaaagcaccatggccctatgctcttaaacatgtctctatttttttttaaagtaacaggcatgacagcaactgtattggtttactagagttgctgtaaaccacactctgggtggcttatacaacagaaatttgttctctcacggttctggaggctgcaagtttgagatcaaggtgttagccaggttggtttcttctgagggctgtgagaaggagcctgttccatgcctgttccctagctgctggtggtttgctggcaatctttggaagaagcatcaccctgatctcttgcctttattatcacgtgacattcttcctgtaagcctccctctgttcccaaatgtcccccttatgaggacactagtcatgttggattaagacctaacttaatgacctcattttaactaattgtattagtaacaactctaattccaggtgaaattacattctaagatactgcaggttgaacttcaaaatataaattttggggggatataattcaacctataatcgcaacctataaatttgtcaacaagttctaagataaattggcaaaaaacataatagatctacggtagataacacaaaggaaaaccatggacatttagaacactgctaagaactatgataaccagtatctgtacaaatgtaattggctctggtgttgaagaatcaattatacaaatgtatgtaatgcacaagtatattttatcataacctctgagaataaaatgaaataccatatgtgacagcactttacaagctgtgtggtattcaaattaaggcattagttttattgctattaccatgtctttatttatataggtagcttatttttattgttacattgggcatttcacatttttatggtccatttctttttatttcagttacatcctagattaatatcatctatgtctatttcttcttaggaaactgagtttctccattcctttttttccttgatcattagaaaacatctttcccaactcccatttaaatgcaaaatggagtcctggcactgggttgctcaaatagccaactccatctaaacttagctcacgacagaaggaacttaaactgtcagcaaaatcagcacactgactgcaaaccagttctcatagagatcaattataaattgagacggtgttctggatgctttagtcagatttggctggtaccccaatgatctctgactctatttcttcagatactagtatgaattttcatcttcaattataacctgctaccaggatggcatatacctgatcctcttctatttattatttattttgcagaaaataaaaataggaaaaaaaccctatgtttgtacttttacatttaactcaaaactcaaatattagtgaattcctttgatttatgtgaaaattaaagttggatctaacataggcatccagcctcctttttttgacctttcgtcatactctctttgctactctcaaatttggtcaccccacactggagactggtaatttgcaagttaattcattcatccagaatttattgagcacccatcatttatcttgtactcagctagcagctatagaggagataaggctagttgtaagtatgggatttggtgaatttaatgttattgttttgattaatgactgggcccactggtttccgatatgcagtactttgcaattttgaggggcactgacttgacatatgcgctgggctttgagtgggagccctttataagtgagggagtggagtgaactgctcagcgcccacagctcagtggcttgattgttttccacttgccacagccttggctctcctcaatttttaattttctgaattttatagggggaaataatgtactgtaatggtaatcatggaaagccttaaagtgtgtctccaaaaatactgaaactctcttctcctgtataaaataaaaaaggtttgcaatctagattcagagtttagaaataagtaccttgacattttcagcccctaagagaaccttttaccccctaaactttctgtagaatttataacctataaccaacaaaacaccaagttatttctcaagcagctatgcagaagctcttctatttggaaagggaattaacaaaatcagtataagacttgggagctttctgcaaggagtttataaatctcgtcggagagaagggacaggtttctttttatagcatcaacacaagtcaggaaagcaggaaatgataagccatgttatttgttccggagtctttaaacccagactctacatctaatcaccatcataaaaatgccttttttttacctccagctttatagagaggagcctcagagtgggccatcctggaggagtgcacctatcagttgagaaatagggatgacaaggatgtaggcagctgttgcattctaaaatgtgaatttgttttgtgaaagcctttcattaacaaaattatgtgccgagaaagggcaatgacaaaactgaccaaattccttcccttgtaggtcagataacatttaagagctttacatgtctaacaaacttgaggttgctcaaactggacaaaggaggagattaaaacactttctgtgatgacataaagcagtgctacgggtaaggcctcagtctcctgccagcagaagcaaatgtattttctccatttaaaagagttgccttcttaacccacacttccccaggcattcggtcctgatagggcttggtttgactgattaattgtaattctgctccatacaaggtagacagtgatgaattgatacattaaagatgtgattaatggttactttctattcagtgtaattatcaggtgatagtttcaatgaaaaatgctggaaaatgaaacttttcactctagataactatccaccctgtctggaaagaaaaatggttctctattttcaacattttactctagatcaaggccaagagagacagagagacacagcacactggctttgtgagttttatagaatgagacggatttggaataatgcctgtctttaaagaaattcttagagaggaaatctctggataataaaactttaaattttatcttaatcctggattactttgccagctcctgcctggtctttctggtcaattctggcatttaatctatcctgaagatggttttggattaatttccctaaagcaccgcattaatcatatcacatctgttttttttttttttttcggagacctccaacaacttcccacttaaattataggaagaacaaaacatcaacatgaccctcaagaccctttgataaaaggcaaacactctttgtcaaactgtttcaattcctgtgcgctgttctttcgaggctgtcagctcactgccatctcagctggccatgatcccccgaggccatgctttgctttgcctctttttctacatgtttttagctggtagaaaaaattgtggacgacttaaaaagggaccaaaagattaccaggtttccttaatggagaaattttgtgctgtttagaatgcatcctctgattcatctgattctgtagggttttggcatttcattgttttggaactattatataattttgtggagttagaagttaacttgcagaaaattcatagaaatataaaacatcattttctttttttcttctctttttttttttttttttttttttttttgagacagtctctctctgtcgcccaggctggatggagtgcagtggcgcatcttggctcactgcaagctccacctcctgggttcacgccattctcctgcctcagcctcccgagtagctgggactacaggtgcccaccaccacgcctggctaactttttgtatttttagtagagatggagtgtcaccgtgttagccaggatggtctcgacctcctgacctggtgatcagcccacctcggcctcccaaagtgctgagattacaggcatgagccaccacgcccagccaaaatataaaacattattttctatatacatgcagataggttctgtccaatggagattcaatggacttttctaacctgctgtggaagaagccaggtttttctgtgttaagcaaattcatgttggcatttttgttggccttttatagttactctttgggatctcctttgaacttaggacatgttaattcccatcttcctaactaatgagctaaataaaatctttgacatgtacattttatatctgtgtaaactcatactcatgatttacttattttaaaaatgatcctttaatataatctacccaatttaaaacttagacaagtttttagagcagttttaggtttacagaaaaactgaatggggcacacagggagtatgcatatatctgccacatcctttcccagttttccttgttaacaacatactgtaccacaccagagaggtacacttattccaattgatgaacctgtattgacacatcattatcgtccaaactacatagtgtacttcaggtttcactcttggtattgtacattctatgggtttggataaatatatagtgacatgtatccacccttctgtctcctacagaatagtttcactgtcttaaaaatcctctgcactctgcctatttatccctccttaccctcaacccctgacaaccactgatctttttatgtctccatagttttgccttttccagaatgtcatatagttggaatcatatgattggcttctttcacttagaaatatgcatttcagtttcctccatgtcctttcatgtattgatagctcatttctttacagtgctgaataatattccattgtctaggtgcgccataatttattctttcacctactgaaggatatgttggttgcttccaagtttgggaaattatgaataaagctgctataaatatcagtgtgcaggtttttgaacagatatatgttttgaactcattttgtaaatgccaaggaactggatggctgaatcatatggtaagagtatgtttaattttataagaaactgtcaaactgtctttcaaagtggctgtgccattctgtattaccatcaccaatggacaataactcctgttgttcaacatcttcaccagaatttggtgttgtcagtgatctggattttggccattctagtgcgtatgtagtagtatctcattttgcttttatttgtatttcgttgatgacgtatgatgtagagcctgttttcatatgcttatttgccatctggatgtctcctttgatgaagtgtctattcagatctcatgcctatttttttaatcaggttgttcattttcttactggtggactttgatatctaaccaattaaaaatttgaactcaacttggctgtacattagaatcatctatagagctttcaaataatacaggtttgacttgtgtacgtccttattactccagtaagtcacatatcactggagggatggtgatggcatacatagctaagtcccatgcagagaacttctgatttgttggggcctgggaatctgcatttctaacaagttcccaggtaacaggaagcactttgagaacacttgctctgcttagtatggattactagtagtacagtttgttaggctctcttctttctctatattagcctgttttaaatttaattgtatgtcccatattttgtttacaattagctatctaagtatatgtgcttttgtaatcatagcttggaattgcgttttctaggttagttttcaaaataatgcttatattctgctaagtccctgccttgtatttttgttaacagactgacagaaattggtgcctggcctatggcctagtggtcttcagaaatgttcttccaaaagctttttaactaagaagacaaaacaccatttctactcaacttagctattatccttttaaataaaactttttgtaaaaatatcccaacacaaacaataagattaaacaaaggatcatagatttctccctaggattatactctctattaagcacagaattgaatatatgtataatcagattttaaaatgagtttgggtctgcctaacctaaaatgtagatgagtctgcctctttctaaaattttaaatcatagtttcttgcagagaaatctggggatgtttaactgaaactttgactttttaaatttgaattttctgaggttgcagttgataatatttaaggtgaatttatttggctataactgaatctttgcactaaaagagagaaatacctgctattttaaataaatccaaaacaacatatctgcaaagctgaataaagtctattttctctcatataagataacgtatttcaaagatgatgagatacggagtaacctcttgatagcatttggttccctcctcattgatgttccactgttatgaatccttgcttaatataatgctcattctccttctaggcttttcttttatctcactataaaatatttttgaagcaaaagtccttctggagtgaacacacacatgtatgttaagactttaaggtatttacctgttaagaaatatttttttaaaaaagaacaaacagaaagcaaaaagagaatcacgaaagattcaaatgaatatttcttattcatttcgaaaagcatgaaatttctatcttagcattcatagatagtattctgagcatgcattttacccttttgcgtgttactttaattttgctttgagacaaaagctgaaaaagaagtatagtatatgtgtgcatgtatgtgtagtttcttctctttttgtagttagtgaaaagaatttacagataatggtatatcagttaaaaccaagcttaaatgtagtgatcactgaggggcaaatttctgctttgcttagagttgttaacaacctcaggtcacctgttacatacctttatttatttgtttatttatttattattattatactttaagttttagggtacatgtgcacaatgtgcaggttagttacatatgtatacatgtgccatgttggtgtgctgcacccattaactcgtcatttagcattaggtatatctcctaatgctatccctcccccctccccccaccccacaacaggccccagagtgtgatgttccccttcctgtgtccatgtgttctcatttttcatttcccacctatgagtgagaacctgcagtgtttggttatttgcctttttttaaattgagaaatcaattatgaatatttacaacactaggcagccaatgactcagataaactgcatttgaacttgtcgtggcctgacaaatgcaggctttagactttattgttagatattaagaatggttcacttttatgagtgaaaaatgtgaaccatcaggaaaccagaaatagtctaggctagaaccttagcaccaccatgaagacttgaacattatgtgaaggggaaagtttggatctcaaagtggattgagctagaagcccatcaggatccaggttcagcatctgggctgtgaagaaaaattatcagacttagaacattaactgagaaagcttgtgttagctttttatttttgcataacaaattaccacacacttaactttaaaacaatgagcgtttattagttcatagtgccgcaggttagaattttatcactgcatagctgggttctctcttcagcgtatcatgaggctggaatgagaatatcatatgacctacactctcctttggagactctagggaagagaccgcttccaagctctttcagattgttgacaaaatctagtttcttgtggttgtaggactgaggttgccagttccttactgactctcagcttctagagactgcctgcattctatgccatgtgcctccagcgcatttccctctcgttgactctctcattcttctactcgctttgattgacttatctgtgattgccagattcagacttgaagggctcatgtgattagtccagctccacccagatagtctctcatttttaaggtcaactgacttggacttttaatatcatttgcaaatccctttccagcgacacctagataagtttaattgaatagttgggagtaggcagtacatcaggggccagggactctggagccatctttgaattctgcctatcactgagctacaagttcaaactcaactgggcagcaagctgtcgagctggcagacacccagatcaaggaagcattgctgcagagtggacatccgatggacagtggaatcttcaatatttcaacagctacacagtgtcccattagaaatgatggtggcgattaccaccagaattggattttctctcaacttgatgtccctagaaggtctgaatatttttggacggagtatgacaccaacatgtgggagcaatttcaggttggtaaagcctcaagaagggatagagagtttcctgacaaaaggacacatagaaaattgagaatgatgtgactttgtattacaaatacacagaggaattcataacatataaacattgttttatggcccagtatgatggctcacacctgtaatcccagccctttgggaagctgaggtgagcagattgcttgggctcaggagttcgagacgagcctgggcaatgtggtgaaactccatctctataataaatacaaaattaattagctgggtatcatggtgagcacctgtagtcccagctacttagtaggctgagatggaggatcacttgagcctggggaggtcgaggctccagtgagctgggatcacaccactgcattccagcctgggtaacagagaaagaccctgtctcaaaaacaagcaagcaagcgaacaacaacaacaaaatacccacattgttttattaacttgctataagctcttgccccacatcaacccttgatatttgccatataatatgggagacatatgattaacagcagagtggggttcagcatccctgcgtcacgtcttactcactgcatgatgtgggcaaattaatcctaaaccttagttttcttttctataaattgggaaataaactagtaccagcacataaattatgaatagtaaataaaatacaacatgtaaaaggcttacagcagactttagttaagtacttgataaatagtcactatgttgagattaagttgtctggttcctaaagttaccaagccattgctatggtttgtatacggtttgtttggccccactgagtctcaggttgaaactggattcccagtgttggaggtggggcctggtgagaggtgtttgggtcatgggatggatccttcatgaatggcttggagttctcttcaaggtaatcagtgagttcttgctctcttagttcccatgagagttcccaaagaactgattgttaaaaagagcttggcatctgccccatctctctttcttctctcttgccatgtgatctccacgtactggctcccctttgccttccaccatgagcagaaggagactgaagccttctccagaagcagatgctggtaaccatgcttcttgtatggcctgcaaaaccataagtcaaacctcttttctttataaattatacagcctaggccgggtgcagtggcttatgcctgtaatcccagcactttgggaggccgaggcgggcagatcacgaggtcaggagttcgagcccagcctagccaacatggagaaaccccatctctactaaaaatacaaaaaaaaaattagccgggcatggtggcgcgtgcctgtaatcccagctacttgggaggctgaggcaggaaaatcgcttgaacccaggaggcggaggttgcagtgggccaagatcgcgccattgcactccagcctgggcaataggagtgaaactccatctcaaaaaaaaaaaaaaaaaaaatacacacacacgcatgcacacacacacagacacacacagcctcagttattcctttatagcaacacaaaatggactaaggtagccatgtaggtctttgatcatttttaaactgattttttttttcatagaataggatctacgttgagtcattcatttactgtccatttgttcattcagttatctaagtcatatttatcaagctgcagacaaagcaactgagatgccaatttaaatgagaaacaaatccctggagcttgtggtgcttacagcctagagattctaaaggggatcattcgcactctcactccacttcattctcactgagattccaagaaaaacttaaagggaacataatggcagttttaaaatagagcaataaagcaattttctcacattccctcaaacactgtaaactcttgcaatttagagacataattttacacatttttgattctacctaaagttagcatggtgggagcacatagtacattgatttaaactaaaaatactagaaacaggtattgtctttaggagaatgagcaataatatttgtgaggaccagtgtctaacgattaggcatcatcttaaacaagaaacatattgatttattacatgaaggttacaggcctaacacaaaagtcaaaatgaagcaacatttactgcaatctatgcttttaagtaatgcctctcaacaaggtcccaggtgttttagaagctgcgctattttagcacaaaataatatactgctgacttttcctcattgcttttgaaacaatatggatctacttttgtctcatttacagaacaaataaaaaagccctagattcagtgagtcagtaaataagacccatttttaagagaaagctgagatcctcagaaaataattggagagaatgacaggggtttatatacaaaggcgtaactcatgacatcattagtatttgtagaaaattacaacttaactacatcactagcaaaaaagaagtggttaagtaaattaccaaatagtcacaaaagtgccatattaggcaacatttacgaatgttcatgaagaaattttattggcataaggagaggcttagggcaacgttaaatgaaaataaaagcagactttggtcctatagcattgcaggatgactatagttaacaataatgtattatataatttcaaatagctagaaagaagatattgaatattcccaacacaaataaatgataaatatttgaggtggtgagtatgctacttaccctgatctggtcactatatgttatatgtatgacatcactatgtataccataaatatgtacaatgtcatttaaaaaatttaaaaagagttgaaaatacacataatatttgcaattatcataatcatatttaatttttttcctatataaaggggctactggttattccatttcagccgaacatcactttagaaaaacagttggtgcagtggttgagtgcaaattgaaggatgtagtaaaggtctccataaccatctggctgagaacagaaatgatttagttacggatttttgttgtatgttactgattggcactcagcatccaaccccatctctttcagttgcgttctatagaagtaggaaacctaaaactcatgtatctgattctctctggaaactatggcactagatgttagattctacaagttagatatacaattatgctgtccggtagaaaggcaaaggtttttttgggggggggggtaggggacgtactgtttataaaaactggaaataaacaagattttattgtagcaccttactagtgagcatcctgtacattttgtgagtgttgaaggcaggggaagtttcttgaaccgggcattccacctcagtctaaaaccaagtgatggcttgaagcaaaggaaaaagcccctcaagtaggtcagttttataaagttctgggagtaattcctggaggcccagcctgtggagtgttcctcctgtaccccagtgaggctgtaggcacttgctgctcggtgttaacccccttcctgctgaaaatatcacgtggtttctcttttctatcctaaaccaaatgaagacaaacagatataacgtgaattctgctattacagggaatattgtacacctttctgtaatgtcattgattatgtttttgtcatgcatgtgttttgagctccttttccataaaaaagtgctcatggtaagcatatacaagaatacacattagtggatacgaggagtgagtagaaagcatgcttgagggtggttataagtgtgtctgctacagactctaaaaaccatttcaaatattttcttaagtcagcactaactatacataccaagataatacattgaataattatcttctggttaccaaatttttcattcaaaaattaataaaggagaaataggtatatattctggaacattattaccttaaccagatactgtctctttctcttttcccaaaactatgtattgttctctagttaccctggccaagatgagaaaaactccaacctcttggtggttgcagaggccctccatgcctaaatattaatagttggaaatacagtctttgtttttactcaagccagcaagcatttatcaagtatatctactggggataaaatagatgctggagatctaatgatgattcagatatgaccctaattctttaaaaaaaactttcactatcttgtgaaagacacataccatgtagtagtgtactggtaaatgtttatcaaccagttttctaagaaaaaaatgtatgtgcatatatatgtgcatatgtttattataaatattattataaataattgcagcacaatttacaaacacaaataaaaatagaatcctccttattgtaagttttatataatgaattgctcctcaaagtatgctttcatcaattttactgaaatcttatatctgtagccaactgatggttgcaattgaggaatgagtgtagtctaaaaatgaatgatagtttatgtttttgtgtatgttaacactatgctaacaagtaagatgaaagggaagcaattaatatgaatcagatcttcactcattcatcaatgacatgagcaattgcttttcttaattgggtaataatttctaaatactgcaaagcattttctggattttttgtgttattcacaatgtaacagctaaaggcacaatacatgttaagtttaatgtgaagtgttaacattttctcaatcactttcttaagtctatactaacaatataacagtaatcaagttctgctttgtaatgtttgtcagtttcaatggtataaatactcccatcatgaacaattgcaagctgctaatggaatgatactgaataaggagttggaaagagaggcatagtacagtacctcattattttagtattcccaccacacaaataaaatagaaacaagtaacttcaaaggcatatataatagtaaaatgtaataagctaattagggagtaaggagttttgagcatttattaaatttatctttaatacaatttaactgtaatttcatagagtttacttttaaataatggctgtatttaacaattagcttttgaaattcactaaaatgtaaggagtggctcttgtgagcctataagggccatctctagcacaacactggatatgtgattggtgataaaggtggaatgaagcatgaggaaaaaatagtcgtctgtatttggggaaaatcaggaaataaatcctgaataggagccagccaggcaacactgggaggtgtagtgaggggacatcccatgcagagcagggagaagggttagtggcagaaggtatcacagcccacttaaaaccttccctcatctcttagcattcgaatggggtaaggtctgcagaagccagattgacaatgaaccttctaggtcaaactgaggtgtgagactttcatcttgtttgagactgacagcctttcagaagttttaaaagcaagataatgcatttgcattttgaagcaatgactctagcagtagtatggagcacagacagtagtaaagcaaagtcatgggtgggaaggccagactggtccatcaacgctgatgttggtcctcttatttgtctttggtcagcatctttgtgctttctctttactgtctttttctaatttgatcctcccattagcaaaggtcaaatcccaaataagtgagagtttttccacccagccatccagatttagaaggctcagaatgtacccaacctcttcctattttttttttttttttttgagatggagtcttgctctgtcacccaggctggagagcagtggtgcaatcttggctcactgcaacctctgccttcctggttcaagtgattctcctgccttagcctcctgagtacctgggattacaggtgtgtgccaacacgtctggctaatttttgtatttttagtagagacagggtttcaccatgttggtcaggctggtctcgaactcctgacctcatgatctgcccaccttggcctcccaaagtgctacaggggtgagccactgcacctggccaacctcttcctattctatgttgactttatacagctacatccaaagtgaagttgttaaccaaaacatcattacagttacaaatttaggaagaaaaatcaaataatatttgatgttattaggaaaagtgatactagagacttgaaacatactaccctcaatgacaatagtgatgcatgcagacagtgttgagaaacttagagagtcgatggaaaatttagtttattttaatttaggctgtatgtagctcaaacatatgctgagcttttataattaaatggagtttctttcgaaagtgtgacagctctttgctttctttctacaagattgaaattagagttggaggacttgtgacttctgaggacagagaagaatgtaagcagcagaaagtttctgggaaactttctagattatgatttgaggcgattatttcactgcctataccccagacacctgctacttcctgtttgatggtaaacttttcccttcagtttttataaagagatatggcatctgggacaattgcttggtcacatgaatttatttgagggaggtcagcatttctagacaactttgatatttaggtgatggaatgaaagtcaaaaaaaccagcattgagattttaatttgaaaatactgagttaagtctttagtgttaatagagctatgtttcccagttttgggatttcatgaggaatatgcttgtagagctgaggaatgatgcaggcattatgaacagaattgaaacaaaccatataaaaaaagctctcatcaaaagaaaggaaaatagcaacaaaacaaaataaataactcttccccctgaaaaaaaaaccctcaaaacgcttgaaaacatgttcatgctgaaaaataatcaaatacattgaaattaaaacaacaatgagatattcttatatatattctaatgagtatatcaaattgaaggttcacaaaaatatatactctcatctactacttttatggtgaacacttttaccatataccttaaatgtttatgtgtcttgaaggtacaccagtctctagaattcatgttcataactggtatataatactgcctctttctgtaaaccgctatgtgttgttggtctttttgtgattggtttatttagaatttcatttgtgttctacaacctatattagatcttaatctcttccagataatacaaaacaaaacaaaaaaatgctttttctctcatgtttcttttagtaatgagacttttatcaacagttaaacatttattcaccccaacttcattccccaaaccactggaggcagcctaccgcaaaatcaaataagtttaaaaggacagtaaaaggacgaaagtttaggaacaagaaaaaaatgaatcataagaagaaggctgcagcatgagaagaaaattagaacggtaatatagaaactgtaaggaactctaccaatggaacagcagagccacgcaattaatagactgggcttggaagtcaaagggaaggagccttgaccagctccactgcttttattcactgagtgctaagagcagctttgcataggatgctccacgaagagctgtgaaataagatgtagacctgaggactgccatagggtcccttgaggtaaatgcactaacgcgtgtctctgaagctgatttcctcactttagaacttctaaatccccgcaaatctccctccaaatttcattctgtctctactttctaatattcatcgcagtcggtcttttaaaaatattttttaaattttattttatttttaattgacaaataataattgtatctatttatggggatacaatgtgatgttgtgatagatgtagggttcacatccattgtcttttgctgtagcctagcaaacgggtctagctttccagcaccagagccagaggaagccttgctttgtgtgggggattggcggggagaagtgaagaaagcaatggggatgcatttggtctcctctccaagctcccttccttccttactttatagcatgcccacttgcaacaagaatcagcctaggacacccaaagtgcctttgcctcactgctgtttgctgcggttgtgatctttctcactggagttgtgaaaaagcagaaagtgagtcctcaatgtgtcaggcctgctgagctactgtgatggttaatactgagtgtcaacttgattggattgaaggatacaaagtattgatcctgggtgtgtctatgagggcgttgtcaaaggagattaacatttgagtcagtgggctgggaaaggcagacccacccttaactgggtgggcaccatctaatcagctgccaaggaatataaagcaggcagaaaaatgtgaaaaggggagactgttctagcctcccagcatacatctttctcctgtgctagagaattcctgccctagaacatcagactccaagtttttcagttttgagactcggactggctctccttgctccttaagcttgcagacagcctattgtgggatcttgtgatcatgtaagttaatacttaataaactcccttttacatatatatatatatgtgtatatataaactcccttttacatatatgtgaatacatatatgtaaaagggagcttatatgtgaacacatacatatgtaaaagggagtttattatatattatatatacatatatattatatatacacacacatatatgtgtaaaaggaagtatatattatatatacatatattatgtatacatatatacatatatatctcatatatatacatatatatctcatatatatttatatgcacatatatatatcctcttggggagaggtcaaaagaagcaggggatacaaatctgactgcaaaaagattgaaggacagtctttattgaaagcctttggtggggatacagaggagtgaattatattgagagataactcagctgaattttctataaattcattgttgctatcttccattttcctaaccacctgctgacttaacctgggttctttctccatttgctctctgactctgcttacctttcctgtctctgtggtgcttctcggtctttctctcatgttccttccattagtctgtctgactgtctctctctgtctcccccagcccccactggatcttcctgcatgttctctccttccagattattctctcttggtgtttgttctatgctttcttgtaaaaaaacatgttggcctctctgggcttttgtaattaatacatctggtcataggggaaaagaatgcttctaaatgttatttgtttttccctgacatgtatcaaattttagttttcactctacctaaagtcccgtctccagtttgaattcaccactcttgctggtggttagataagcaagcaacagacaacgtacacacagaccacatattgagaaacaagggagcctatttgaaattgcagaaattaaaacaacaacaaaaaaaagatgcataaggagctttctgaggagtacatcgcctacccaccaccccacttcaactggaaatctgtttccagtcagcagaaaactgaccaaagacccatcatcaattatactttgtgaggatggttgtctctgaaatatgcagagtggcccagaaattgtagaaaagaagggtttggaaggtccatgcctataaagccaacaagacactttctgcacctcaagaaaagtagtctcgctgttattgtattctgtctgatcaattttccttattttaatgacacatagttttcatgttttgtaatatttttgtcatcacacatggtaaaaagccaacccatatagtctgaggtggaggatgggaaagcataagacattcatacagtgacccttcaaacagtcacagatgacatggttcctggacagtggggcatatctcccagatgaatttcaatgaaagcaattctatagagagcagagaccattgtggcctaaacaaagagcttttcagtgacccaggaagagccaagtatactacttcaggcacctggagcaatggatgacctgaatgtcctcaacacaatcctggatcattatctttactttcaaccagattttgataagaggagatgtagtcagtgatttgtaatcccacagtggtttgccaatggttgctattagcaggaaatcaattcagagatgtcatttgaggatgaagctcctcggtattttgatgcctttttaggaagctaagaggagctccactaccagctcttcagaaaaaatctcctgagttgcctaatttcacctgaatttttggagcacacatttaaaaattacttgtgaatcaaattcaatttgaaaatatgcaacttttttagctcttgctttctccctgagctatttcttgaaaattgtggaggaattgcttctgctcattgggcccatttacatgaattatttatttttatatgtattacatatttgtctctcctccctcctacaagctgttccatagcaagacctctcgtccctatatatattcatggtgacattacagccatcttcaccctctgatgtctaaaggaaatggaaattctgagggtcttcgaaaagcaaaaagccaggtttcctttattctagatttctagaggatttcatagccactaaatctgtaataaccagaagtaacatacatgcatgtacctgggaagttcagtgataagataaatgcatagatgtctttacccatgagtatataatgcatcattttaactatatttttccatttttcggtgttcactttgtagtcatacaaatactagccattgctcattgagtactgtatgtcaggaactatgctatgcatttgtgtaaatcatcacatctctttccagttatcctgcatagtattgttactccatttttttttcctaatgataaaactgaggcagagagaagtaaagtaactttcccaaagttacaaaatcagtaagtcatgatttggtacaaatatgccaaactaccaatctgggccttttaactccactctgctgttgttacattatccttctcttgcacatttaagccatattatttcaatgaaattctgcaaatacttattgagcacttgttatatgtagccattgtcctagttactggggtcacagaatgaaaaagtggagccaaattataaggaggttagattctagtagacaagtcagaaagatgaacagatgaatgtcctacagggcagtacaggtataataagtgtttaccacttaactaaaggtggctcagatcagagaaagacttagtacattatggtgcttcaggatgctcactggtggccaggcagaaaagagtaaagacaatggcattccagcaaaagagagaggcatgggcagtgtcacctactggtgaaataatgcagacaaaaaaccaagaagagtaatttggtactgttgggccataacagatacataggggaatggtgggaataaggatagaaagtgactggggacagacaataaacataattcagtcttacaagtttggatttttccatgtaagttacaaagacccattcaaggaattttaagcagagaaataatcagaacaagtcatgctcagagtaaatataggacatcaaattgtttatcaagaaaaacagtgttttttattatactttgtgttttactggcaatgacatattcagtagatctctttttatctcagttgatattagacattagaaatgaaggctgcggctatattttaaaatggtaaagatcttccatctgtctagataaaattttgttcaacgtttcagtcacttaggtgatggaaatttggctctcctccatgaatcccactttccttgactccttcctactacaatgtcaattctcctgccctttcaaggtagagaaaagtgtttgtagtctcaaagataccagatggtatctttgcctccttttgaaattcatggcacttatgttattccacttttccactcaatgtctttgtcacttgcctatatcctagttgctaccagtgtcacagaaaactctgaaacttgatccttgattctcctttccatttcaactcccaccatcatttttgaccacaccaatatctttgtatgcagtacaataatctgggagtttgtagaaggaaaatggtacttttgactttggggattaagagaagttttaagggagacatgttctgttgctctgctcttccaaaggtaaatgaaactggaattattaaaaattgggagcagaggccacatttcctagttggaagaaacagcacaagcaatggcataatatgaaaagggtggcaggaaagcacataatcctgtgtgattgcatcatagaggatataaaaaggggcaatatgatacagggctaaagtggctaacttgttctacattttagagaaacttgttttaatatcaagagaaggagactgaatttcatttggctggcagtggtggcagggaggtggagatttttgagaaatgtaatgatcaaactgtgccttaagaaggtgaatgaataattttttaggttgggaaagaggatggagagagggagaagatagagtgcaaactgctgctaactattttgcttgttgtccaaagtgtgtctaagatcatctaggcagaggtagcaggaagtagaaggagcacagtgtctataactgcgtttcaaagaatgccaacacttaataactgaataagcttgggttggtattcaagtgaacttgaggaggagtgcctgacaggaaggagggaaaccagggaaatacttggcagtggcaagtagagagaatatgctctaggtcagaagcaccaatagtgttaaaatgaaaacaagaggtcaaataagatgtgaactggacagtaaatattagttataataacatggagatcattgatggtcttagctggttattagatcatttgttagcttcattgggggcagaatctgggagaatttggtagaaggaagtgctgcaaagtgggagactcttgagggaaatttttaaataaacactgttggtataattaggaggggcagatatacattcaaatcctgcttctcaattaattttatgtgtggcctgacttctcgaaatcttagtttcctcccggtggataagagaatggaagccaatgggtcattatgtagaataaatgagatcataagtcaataattggatgaaaagagttctgcgtttgcttgacctaagtattcaataatggtggcaattactatattatttgaatctggacaattgttacatattggaggaggaggttacaggtgtatacataacttgttagttatgttttgactgagaataaaactgttatcaagaaaaacgaggaagtcaaaaagataatctaaagaagagaatgaagtaggtttgtaattttttcccttttaaaaatatgcatgcaatgaaatgtgcagatattttacatttctgtgggttttgacaaaagcttatacacatttaattcacaacctttgaggctatattctatttctattactttaaaaagtgccttcattttcctttgcaggtcactcattctaccaccacctgtgggggcaactactgtttatttctataaccatagattagttttttctactctaggttttttggagtgatatagtacatacttgtttgtttctggcttgtttgaatatactactttttaaatttatccctgtggtttggggcactgatcgtttgccctttttttcattgctgggtttaaatatactaagtataccatattttttttgtttgttttaaaatctatccacttgtttatggacatttttgttgtttctagttttgcgctattttgaataaaatttctgtgaacgtacaccttgtataagtttcactgtataagaaatcatcacatgcccaagccatgtagatagttccttatgtattattttgttttcccaataaactttatagtcagcttttatgtttagagcgggtattcatatagatttaattattgtttgtggctagaattcagtgtagttcatgatttttttctatattaatattaacatgtttcagtgtaatatttgaagtatttttctttctccattgaattgcttcaaatatttttataaatttgtcttttgtttttagaaatatgactattatgtatctagggtctatttttttaatgtgtattctgtttgggattcattgagcttcctctagggatcaatttttttttcccagatcagatttggaaagttttaagccaccatatctttggatatttatttctctgccaatctctttgtcttccttctgagattccagttacacagatgttaaaccacgaagtgacccaggggtcacttagattctgttaatgtttaaaaacttttttccctctctgtactgattttataatttttatttctgtgtattgaagcttactgattgtttcttctgtaatatcccattttctgttaagcccataagataattttacatttcagatattatactttttaattcaagattttccatttggttcatttttatggattccattcatttgatgagaatttctattcgttcactcattataatatccatcctttccaaaatcattgaacatatttataacagctggtttaaagtccttctctattaattcaaatatatgtgatttctctgggcttgtttccaatggcaatttttttctcttggttatgaaagaaatcaaggtactttattatcattggaaccatgatataaatattgctgtgatttgacttgacacagctacaagcaattttgatatgccttggcatcattaatttattctaatttagtgtttaatgtcccagtaataatatttctagcctaagttggtgtagaatagaaacctcagctcttatgcattggaatagaaaaatacgattacacatgatcatgaaaagcaatgatgcctgaatatttggatttgaactgttttatctcacttaaactgagagtgataggttaaaagagtagtgctgcattgagtaaaggctattttgacagaatttgttgaacctgtgtttagaagttaagaaagagaggaagaagaaacaggaacactttaaaagagttgatgccaaagacagacacataaacaaaggtgagatgcttttctatttctctcccaacttaccttagaaggctgtgctgtagcaaacgactcacatttcctatgtaaagcctgttagaaactttttcagactattgaatcgccacaaagagagcaaggtgattttgtataacatcttattcagtatttactagatagctgatacatgcttggcactctaatgacgttgtaatgggtgggcacatccatggttcttcatcgagtttagagactggttagtgtattattttatgctgttaattttacaattgtgtaggtgccaccaagtcctctaatgaacaacctttgctttctgattctagaccaaagatcttctcacatatatctatttcttacatctatttcttattccataatctctcaatctcatgttctttctgtaaggaatgagaatggagatagagttatatagagatcatagaatcttggatgtggctttacagttgtgtttttttcttctgttttaaagggattggggagggaggtcttataagtatatggtgtttcacagatacaacactctgggattccatttcaagttttaatgatagtataagcagtacattgaaagacagccaataacattcatctcttgaaataagtatgctgcagggctgaaataactttggctttattgctttgaaacttcgtgaagcttgggttaagctcttggctatgttacatctgagaaatacagacctcgtttcacctgttccacactacagctgcagttttatttggaaaattgatgagggcattaagttctgaagtcatgttgattctaatgtaaataaatggtgtcattacttcatagttgggagtgccactaatgcagaccttaaaattaagggttatcttgttgattgggggaaaattaaagtaatcaactttcaaggctttaataaatgagattgcacacttaaaaatcattttcaaaccagctttaaaagtagatgactagaaaatcaatagcaataatacatacctatggaaacagaatgggctatatttatttttaaggatagtttcttgtgttatttggtttgaatttattaataaggggcttaaaagtaatcatataaaatattaagtatattttcataggaaaataccaatggtattttttgtggcagttaatacacatagagccatgaaagttgaattttccaaaagaaaaaaatgatggtacaggttcagtacacctaatgtaaattcatgaaatcaaagtatataaaggtttttctaggaagttagaggtagagagggctcaattctattcctgtatgtaatacttgttaatgtgtgtgtgtgtgtgtgtgcatgtgtgaatttgtgtgtagcatttattacattataaaatatagtatataaccttagaaactaagctctttccaatattggaatataaattgctttaaatatttggacacaatcactaccatcactattattatcatcatcatcccagctcatatttatgtagtctgagtctgggccagagagattccatgctaagtcctatttagtatgaagtgggctctcaacctatatctgtgaattaatctttgtgtcaccacaagtgtccagtaggctgatctgaacaaaatcagtactcaggatatgctttgaactgttaacaccagaaggcaagggcaactttcacttttacacacataagggagagtgtattcttcaatttcatgagtagagagtggtgtacgtgagaataatttataaagtgatgtcataagtccctatgtgcctgggaaacacaaacctgcctactccagacaacaactgggtggtttttattattgttgtttgcttttacgtttgaagcagacttgtgtggcacttcagaaacaatatgagatatttagcagtgtataaatttgagtttggagttgattcaggtcgaactttcaacagtaatctgatgtatatgtaatgggatacataattagtagtgtgctgtattgtaaacatggcggaaaaaatgtcagaagactacatgctagacagtcctcattgtctgtcttgccatccccagttcctggggccctggactaagcaggcacaatgggtctgagccagaaaagtccccattgtaagtataatcatagtcattgtaataataaaaatgatttccacttgtttcaatttactacatgccagactctatattacatacttaacatgcatatctcattttaataacaacactgagagataaataggttcaattttcatacgaaaaaaatggaggctgaaaacttggaagtgagaatgatatgatataatgaaaataaatgaaatttgacatcagataggcagcattgcaactcatgattcaccatctattatgtgatcatgggaaaattactcaacttgtctgcgttttaggttcttaaaccataacgtcgggattacttttgttctcctattctgaggatgcattcagatatgtatgtaaaactccaaacatagtacctaagacataggagggcatttgcaaatgttggtggtcctgacctcccaccattccttattgactctgcagagttaatgttgacctgggaagttttcaccctggctccagtaaggaaagtgaaaatgactaatgattttctttatccagtaaaggatgtggaggatggggcggtaaacttgggtacttttctacatcctcctcttttcctggcaaagtcccagtaaatacttatgatagctttgtgtaaaaacagcacctgtagccagacatggcaccatggaaggcaggttggtgggcaaatgccctctaagtgtaaaaaagaaggagtgttgtgggtccccagatcacccaccagatttgatgatttgctagaaaggctcacaggactcatcttgtagtcatatatatagctacaatttgttacagcaaaaatatagaaagcagaattaacaaagggaaaggtacatggggcaaagtttggaggaaactgggtgtaagcttcctagagtcatcctccggtggggtcacacaggattgcttaatttcttcagcaaggagttgtgacaacacataaatgccttccaaggagtctaattggagtctcagtgcctagagtttctataaggggctgctcacctaggcaacttctccatgtaccaaattccagacatcctgaagtgttcagcatagaccatatggtttgcataaacaggcaaggcacgaggagccattcttatcagggaatggtgggaactctcttcaaatcccactttccagacctagccaaggaccaactttgcaagcagacctttatatggatagcagtctcaggccttctcagtttatattaactcatattaacatagtcttagggtgggttacctcttacctgcacagaaagacatagttgcgtgccaggacacaagcatagcagagcaggaaacagatggagttttgccctgacccatctgcgtgtacagatacctttaggcaatgaacaatctaccaaaccatggatggcttccctgcctactagagaagcctcacatggaagagcacgctgtgtatgacctcattctgccttcactctctggtcctttaaatgttgattgatcagccttttttcactgacccaatttgccttctctgaagatgctttttgcaaatacagcaggtttgatgaatgcttagcaagaagtttggatgacttctgcactggtttctgtctatttggggctgattggaaaacttaagacactgaatttatcttatacttgaaattctgtaaccactgttatttatgtctctgtgtctgtctctttctttaatctttgttttgtttttcttcagtaagcagttctgtgaggtagttaggactatgattgggtagttgaggctccatgtggttaagtaatcatatcagaagaatttgttggaaagactcagaccagaatacagatttgctgtttcttgaatgagcatctcttctgttgaatcaaattaatactataaaagtaatttcatggaaagaataatcataaagaggcaatatcagtccaaatacagaaaggccttgcttttctgactttctgtagtagtagcaaacccagtggagttctgaagaatgtggtcattgctatggattgatgttagagaccagagctagattagtcagactggtcaactcttctagagtgactggaaacttaagcatctaagaacaagggcaaatcagtacaaatacagttaacccttgaacaatgcaggtgtgaactgcatgggtccacctatacgtggattttcttctgtttctaccatccctgaaatagcaagagcaacccctcctcttcctcctcctcttcagcctacctgacatgaagatgacaagaatgaaaaccttcatgttgttccactttcacttaacaaatagtaaatatgttttacttccttatgattttcttaataacacatttctttagcttgttttattgtaagaatatagtatgtaatacatataacgcacaaatatatgtcaatagactgtttatgttattgataagctttccagtcagggataggctactcgtagttaagtttttggggagtcaaaagttgtactcagattttgaatgcacagggttttagtgcccctaaccccgatattattcaagggataactgtaatcaagacctgacaagtcctgtctagtcatcaaatcaaaagttcatgagtgaggagagatgtaggagaagaacttaaggatgacagaatgaatacattaaggaataaagtagcaagtaaggaacagacttcaaagtaaggatgaaggtccaattgttttgccaagaactgggcttgggtgttcacttttcatctctaagtctgttttattttagcccatattatctccctcttatttggatataagatgtccagtaagtgggtaacttgcctgtttggaagccactacctgttatgaacaaggcttaacttgttcatatttcattcagtatctcccaaatgttgaaataacgatttgggcaggagagttagttttataaagacatcccaccataaaagatatttagtattcaataaagcttgcagttctttaccttaatgttgtgtcttaatatattgactcaggtctcacttgaaatctgaaacatgggttccatgatctatacacttaataagcctttaaataatgaaacaggatatacttgaagggccagctgtctttgtttctattttatgcctgcattttatgggcttgatcactaggactcagactggtccttggcaacattgcaaagttagcgaagatctttccagccctttcctgacttcctgctacatggaaattttttctctgactgcctgatgctctcatgctgcttgtatttcagtgtctgccttatccctaaaggatttgcctgccctagagttgtcttatgtaccagatctaggtttatcaatattctgggagtcatttgttaagttctcaatgtattccttcttatagagaagtctcttattcacagtctcatatattcggaccagtctagagtacaatgagtgggaatgacagtctggaaggggagaagacaaatgcaataccatctggtgcccagaagaacttctgcatacttaatcagaccccaaagccttatatcatcagcaaagtgggaagcttagtatctcacattcacataatttttagaagccatttcataccttataaattttgtcgcatttcagcaagagttcttgatatgtatttaaacctggactctcttatctaagtgctgtcattgggaaggacacaaagtgttactgggtatttgagacttagtgtggttaagcatattgttgaaaagatgggactatactctataaattgtgagaataatcatgacttctctatttccccgcctgggatattcaaggagagagtgctaaaatgaaaagtaccataaaagctctggagtagcactgacaggatgatggagacatcaccatggtgaaggttgtcctgggttgtgagatacccttaatttgataccttcttcctaaaagattaattcttacaaagtttgtctgtctccaaaatacaagggccctaatatggatcaaacaaataacagggttctcactggcttttatagaaaacataaaatgtcacttgagaatgagaagtccagagggaacacagttctccatgctggaaacagaagacagcaagaaagaaagataaagtgtgatctaaagaaggacacactgctcctgtttgtgtggatagatacaactgagggaagagacaatttgtaactggaaggataaggcagatttatgggtgtttatgtgcctatgtgacaaaagggaccttggggtgtaatgggctagatttaagtatgaagtatgactgcctcatgaaaatgttcattcatggaccttaaatcttgcacataatgaggacaagaaactgtagctgattcatgcaaatgtctccttatatatttcttaatattgcccattttcttgttcactggatatgtgagactctggcttcatcatctcatcctagtagtcaacagattccttcacagcatttactgagtccagctctgggaatatgcagaaggctgaggtaggccttctttcagtctgtcctcatagtcatcaaacctgagagggaaacaccttttcttctttgccttgtgttctctgcatcttactgagaagatgttgtaatgttatgcttttgtttgattttgtttcctcatagagactttcagactcccactatgtggtttggacacgaagtcagtctgagtgccaccgcaccaaccccaaactattgtttctggacccagtgtggtcttttctttcaaggaagaatcttgtccatccagtgcaggggttggaggattacagaagttcttattcctttatgtattatgacccccaagcttgtgagctggtcatgagcctcaaggttttcatccactttccatctcattaggctttcagccatccctgcaaatagcaccatcttcctaaagccctggtcattactccgtaactctccaaacacaagtatttactggtcctgactaagagacttggcttataggggatctgagtgagatgttggcccttattcttagtgagttacaatcttctgagcagacaaatacgcaggaaataataagagactaacagaagataaccaggtggtttggatgatcagtgccattcaatctctgctcaaagctgacatacttaccactaacccaccaagtacagatttgttctccaaattcagaaatgaacaaataattaaaaataatggtaagatgatcccagaaaagattagtgtagaaggagaggggtttgaggagacggtggtaacagcaaataatttgcagctcgagaaagatgatcatgatgatttcacattgatcaaattctatttctatcatatttatatgaattatctcatttgatcttcacaaccctaagatataaataattatcttaacacacgaatgtacagtttggaatcattgtaccaaaaagacacatacactcatatgttcatcacagcaccattcataatggcaaagacacggaatcaatgatgcaccgggtaaagcaaatgtggtacatatacaccatggactgctacacagccaaaaaaaaaaacagtgaaatcatgtcctttgctgtgatatgaatgcagttggcgggcattatcctcagcaaattaacacaggaacaggaaaccaaatactacatattctgacatataaatgggagctaaatattgggtagttagggcataaagatggcaaccgtagaaactggggatgactagaaaggggagagaggaaggacggcaagggttgaaaaactaactattgggtactatgctcagtacctgtgtgatgggataatttgtactttaaatcacagcatcacgcaatatactcaggtagcaaacgtgtgcatataccccaagaatctaaaataaaatttgaataaataaataaaaggttaaaaaaaagaatgtagagcttggaaggtttgatgaaccgtcactttcatcgagaatacaactccaggaagtgagagtgaagtttccagaaaacaaagcagaaaagcagcaagagccacaatgagggtatattttggagtggcggagacctattcattgcttgatcaatggaagcatatttctccccaggaatctgtataatctatatctcagaactttctcccaggggtggaaaaagagataaatatccttgacttgtgtctccctaggccaacatttatcccctgggcctgaactgcttccgtgacagtcaattcatttgcagattcccaggagccacaatagtctgtagggaagcctgggatgggaggtgagaagcagggggtggggtggtcccagcggtgcctgtgtgaagtgggtctgaccccacacacagatgggacaagagtcaggaggtgaagccaagaggatttgaaacgaggcaaaagtgatacctagtccattactgttttctttgttttacaagtgaggaaatctcaggcacagaaagccaggtaagttgtctaaagttgaaatctgagatgtgatagggaggacaatgtaaacacagagattccaaactatcgcatccaaactcccaactactaattcctaatggaaagggttcctcttgaaaactttcagagaatgacctactaggtgacatagactaaaccttcaaagagcatcaacaagaattgtaagaaacctgtgagtgagaagcacttactgagttaccagaggacagtgggaactaagagggtgtctttaacctggaaagcaaccagtgaagccaaccacatccttcaatcccacatcctttgatgccctcacctctcacgcacaatagagatctgagctgcaatttggcacccttaaatgtacttggctatgttccagaacagagaaaaggcaatgttcgtatctgtttcacgcttgcctcgtgccagagactgctcagtatttcacgggaacaacacttcaaggaagttaatagcatctccatcttacggatgacgaaactgaggcttagatgggtaaaggatgttctttgcttccccacattgtttttctggtatatatcacaggcgtatgttttgttttgggtctgtatttgccttctagaatgatattcaagaggtggggttataaaccctggctgggcattagaataatttagggatcttgttaaaattacagaaccccaagctctacctgaaacctaaggcattagacctttttaacctaggggaacggatatcctaatgtgaccatatttcactggggatctgatgggaagccagggttgacactcaaaagaatggacagaaaatagtgaacatgttcctgagctgcatgaaagaaatatgcaagattcagaaccagggctgggggaaaagacagtcctgctcttctttgtacaaatcaaatcacctctgaagaggtgctttgagttttgggtagcttactttaagtagcagaattggaaggaagaactgtactggggaataggactgtgtccagggcaccaagacaaagccagacataacccaagaggctgacaatttggggaagtctggtgacggcaactctctcacccacagttaacaaacaaacaagaaatattttctccgggctcagtctctgtagttttggcagcagggagtcagcgtccttcctgaaacatgccctgctgtgttcctgcccagtcttgccagcagctcagtctgcatctgggcttttccccaccctctgttgcctaatccacagcatccttatccctcccctcaggccaccaccaccccccttctcccacgcacccaggctgtgttttagcaggacagctattttctgccattcagcactgagtgatcatcatcaggtacagcttcccaaacacacaactgcgctgcttgtgtagcctcaggtataattacgaaggctgtcccagcactcgctacctacactatacttaatggggagggatggtctcttgttctctattaaatattttgaaagagaacccgtaggcatgacaaggttcaggcaccaagcagaaatgggaatcggagtgcccctgctctgacaggcaagcacaagttttaattatctgctcatccaggatttaaaaattttcgttttactataaaaagcagaaaaggaagacaacatgatttcatgtgcttacaggaaatgaaattggttgagaatattgtctgctgtcacttctctcttatttcttcctttgtagtgtttatttttcctgttctatgaataataaatactgaaaatataaaaattacagaaatgcataaagatgaacaacttatgaccccacagttcagacaaaacttctattaacatttttatatgttttcatccagtctttttcatgcacactcacacatacccacatagagacaaaagaattgattgtattatggtagtttaatattctaattgttttgttttgtgttacattatgagaaaatatttatgccaatggatacatttgaaaaacaacttttctaatagttctatatttcatgtttcactctgatttatttcactttatttccctgttattggatatttaaattatttccaatcctttgttgataactcttaataaattaataaatcacccaagatattaatcaagctcatcctatgtgttgtcactgttcatgtcagcattgtatgaagagtgaatgggctttggtgactgaaatgataggactaaatactgattctaccactagctcagggcatctaggaaagtcattaaaaatttactcatctgtaaaacagagctcatgctaactgctttgcttatttttctaattttgttctctccatttcctaggacaaacaaacaatgtcagataatctctttctacatattcttactcattctgtttctctgaagttgcaactacacatatactcacacaattcctttgttaacactacctcattctcaaggtcaaatccaaattctacatcaacgtctccctccactggttttcttcatctctgacccttctttttccaggccctgcacggatggcatcaaggtactttcattgactctggctcttcacctatgacttcttatgcctttgagtctgccatttctttttcatgggattttctcctgacattcctgcatccctttttatccagctcctcctcatgactgagaaatcatctctagcctcaactcctcttggaaggattccaaatcccaaaccacaggcagggctaagcaaccctccttgctgactcttagggctgaaccatttactcagtaaaagagatgctctattttgaactttctcaatttgaacgtttggtgctttttccctcatttctggcaacatttcaatgtttctttgctttctccttactatatctctagatatttcttcagctatacatggtcagatgactggagttcactagaggtaaggctatcctaaacctcattattctatggtatctattgacagcgtatgaatgagtctgtgaggcttattacctaatattagaaataaaataaatcaccgaaaaacttgaagcaaagtagttagcagttcatagaaaaatcctgagttagattcctggctcagtcttttaccagccatgtggcattgactgagcctccaagatgtatgttctttatctgtttacatgaaaatcatatttgctaattcttaaagttatgtatatagagttatttctaaatgacatataataatcacttaatgataattttatgagaaactattttcagctacctgttatttttacaaaagaatcacattaaaagatgctgttaaaactatgagaatacatgagatataggtggttattagtatttggcattcacacccaaatatctaatcactaaaattattattaataatgaaaatgaggcagatgatcatgacatttatccccaaatctctagcaccttgcacagtttctggtacgtatttagctcccagaaataaacactgaattgaatttatggtaaaataaatttttagaggctttgatattccatttttaagcatccaatctattctatacacactcatattagcatatttatgtgacaatgaaactattgcaaacagagagaagattattaggttatggatattaagttaatggggaagatataaaatatttaatagcttgggctagaccacatcttttagaagaagaaactgaggatgaaaaaatttccgtgaactgccaggacacaaaatttgagaggggcggagttggaattaaaacccaaccttttctcaagccaattagaatggcaattattaaaaagtcaagaaacaacagatgctggtgaagctgtggagaaataggattgcttttacactgttggtgggagtgtaaattagttcaaccattgtggaagacagtgtggtgattcctcaaagatctagaaccagtaataccatgacccagcaatccctttactgggtatatacccaaaggattataaatcattctacgataaagacaagacacatgcacacgtatgtttattgcagcactatttacaatagcaaagacttggaaccaacccaaatgcccatcaatgagagactggataatgaaaatgtggcacatatacaccatggaatactatgcagccataaaaaagaatgagttcacatcctttgcagggacatggatgaagctggaagccattattctcagcaaactaatacaggaacagaaaaccaaacaccacgtgttctcactcataagtgggagtagaacaatgagaacacatggacccaggaaggggaacatcatacaccagggcctgtcgggggttgggggcccaggggagggagggcattaggacaaatacctaatgcatgtggggcttaaaatctagatgatgggttgataggtgcaacaaaccaccatggtacatgtgtacctatgtaaaaaaccggcacattctgcatatgtatcccagaacttaaagtaaaataaaataaaataaacccaagctttgcctccctaacacaatttagctttccttcatacttcaccagactgatttatctactccacatcaccggatttttgcaggtctttcaaaatctcatttatgcatctaggataaacttaaatttaaatttaattttatgttaagcattgatcaaacttgcaaagtccctctaagtattgtgttgctcttgttattgctgttgccctctctccccacctctaatccaaattcctaatgcttggtctttctttttaaacaaagaacttgttttcatagaaatgaatctcttgtggatttttatgttatatgtcaagctcccttatgaatctatccaaaacatccaaagaataaatcccaggacaggaggaacttgtattcacacatctaattaacctttaattgtctattgtgactgctttgcagttcaatagttgcttgatttttattgcccgcctaattagtgtggttaaagtggctttttaagtcagattttattatatcagtttgcttacgcaatttcgggatactccgggaagttccaataacattgtgattcttaagtgctatatatgtatacacatttgttgtttgtttgctttttctcctcaggaaaaaaagtgctttgaccaatttctcccactagagtgtatgagtagtctatgaaattccttaatgatagcaaaagccttttcattaattgtgcataaattatcaacacagccagtcaattctaattaatcatttttctacccaataaaccaccagattgacagatttagaattctgaaacaaggggagcagtgaaggaaaccacccaaaatactgcaatttaaggcaaactaacatatatgcacatctctaaaaatcagattctacagctgtaatttattagtgagtccatggaatgtagctaattgagtatgcatctatcaggggatggttaagatttaaaataatcaattagatgtacaaatcttattgcataccatggatcttttttcttctttttgtttgctgttttattttctaagtaaagaataaacttgcctccaattatataatttgtattttcacatgttagcattcttttcttgttccacaaactttctaaattactgaaaattatcatgaatgcaatttaattttctacatactgagcactatggttgtctctaatattggccacggttgtagtttcccttagactccctgagctcttgctttattttctttgtctctattctcttggctttaaaatagagttaagcagtttgaattatttctagatctctgtctctctctgtattggagagacaaaagatctagtgcttagcagagtcctcaactcatcactaatagtcaaagtattcagtggcaattgccctgtgtatgaaaacagcagtgcaatacagagtaaaagtactggggcatgctgtctcttgcacagaacaggaaccaagagtaatgggttctattccctactctatgtttgatttactggttagccttgggcatacgatgcttcttaccctttcaatgcgttattctttccatctggaaaacaaagataattgtacttgtagggagggaaaagggagaacctgacataaattagtttggatagaaattatttgcaagattcaaaaatgattctgaaatgtaatccattccacatttattgggcatttcctatgttctaacaattgtgctgagtgctaaagaatacagagtttgccattacattggtgctcattatctgataaggtgtagccatataatggtaattataatataatgtgaaaagttaatattgatgagcccaactatctatttctagcagagagaactgaactaaaatttatttgaaacatcttctgtaactgttggctcatcataaatcaaagtgaattgcatttataaggatagtttgtctattagtaatctgaatgaaggaagacagggaaagacatctggaaaattaccacagtagactggattatcgcttgtaactctttcttccccattgtgaaagaattacacatgaattgtctttaccacttgactttgtagcgactcccattacaattgacagagtgtgcatccgtcttccattgactgtggttttggtgtaatgacttgctgtacccagtggaatacgttgggccaatgaggagacattgcaccagttctgagttgagtcttgaagagtcatgggaagtttctgccagcctgatgggatttcctaccatttgccaggacaagatcatgcttcaagtagctttgctccttggcttatgataagaacaaagaaatgctgcacagactgaactccaccaaaagcctggattccagtctaacccagatgataccagtctagaccagctgaccctcagaaacacttaggagaacaacataaatgctgttgctgtaacctttgcagacgtggggactgtttgctcacaacattatcacggttaaggaaagaagctggttaataaaacatctttttgtaaactcaaacaaaattattgactaaggaagtggtcatcaataaatgataaaactattaggtgagaggttgatgggaaattgagtctttacatggtgtcagactgtaactccacagtttcttgccaggcagagagaacagacataacatcaatggagagatcaagctttcactaccttagtacagtgagtcactaattatgtgacaaccagacaccataatacagcatatgatgacacatcaacttctcagcatgacctatgaagtgtttttgccaaaagtgattaacctgaaattagcagagtcctaggtcccaactctccctttacaggaaatacaagggatagagatagaaattaaataccaccagttaacatcagaaaaattcatcaagcacacgttctataagacaactgactggttacttcaacaagtcaatgttacaaaaagaaaaagtgacaaaggagtggaaaaaaccatattacaatgcaatgtgtgattctagagtggatcccagtttgaatgaaaacagccgagaaagacactggaagacaattgaggacatttacgtatgggtcagcttttagaatcactcagaaattattatatggttaggcttaatatacttaatatagtattgtagttagtagaaaactgtcccaacttttagacatgtataaggaattatttagagtttatagcttatatgtaaataattgacttgaaattacataaaaacagatactaaaattatggcaaagatgttaatgctgattaaatttggagaaaatatattaaatgtttatgattctattctttctaaattgtatatgtttgaaaaattctaaaataaaaatgaccagtggcagtgtacttaggactcatgctaaaatcatttgagatgtcactctgtgtgcaatctggccctatgtttagtgttgtttttagtgttctccaattatttcactcatttaaaggctgtatccagaaggggtcagtaagctgcataaagataagcaccaagttttatacttgttttcacttagcccaaacactcagtgggtatgcgagtaaattcattccattaaagatgatagaaaggactttcttttcattatttgctattacattatgtgactatttattgccctcctttgttcttatcagaggaagcagagactctggttgtgtgtctccttatcctatgaattagttgattaaatcagtccaggcagtacccacttgaagcaatcatgaagccagtcaaccggctggttagagctagtcagagatcacccaccaccactgctccagattttctctacatgtcagataatacagaatggaagaaaacagactgtgtgtttaaataccaaatgggtccacgcagtgtattttttaggtctccatgatgggccaaatatatttagaaaggagaacattatgacttaaatatgtatcaagaagctctcaaccttggtttcagtaataaaaaggtgtccatcatgttaatatcattggattaattgcaccacttttttttgaatcctctaatcaaatgtctcatgcttgtcatgtaattgttgaaataccagacttgattgacagatattgcaaattccccaagggtaaatgtttccaaaggaaaacatagtcatttcaatacagcaattaattataaacagccattaatgacaagtacacaggtctctctctcaacacagaggtcagaaaagtaaggtttttcctgaaagagatgaaaagttgtggttaccatcatacagatataatttttcaaaatattaatgaaaatgatacaatcatttattttcacccaccacatttcaggaaacacactcaatactctaagcatattttttaacagggttgttggtgtggggaggcggtgcttttgactaaaagtcttgtatgctagcaacattattttaaataataatactaataatagttcaggtggggattaaaatataatcaaaacaaaagtaacaaatcagtaagttggtaacatgtgaactgaagccttacatggaagactacatttttcaatggttttttgttttcttggaagggcattaggtaaatttagcatcagatgtcatcagtataaaataatgtaaaatattgaatcaaataccctgagaattcaaggcagaagtagcactatatacatatataagagaaagaaagggagcagggcggctttgcgttgtaattgtctggatgaaagtcgtaatttctacatcactcttaatgtacagaattaaggtccagagtcaagtctggacattatcaggaattgccactactgattagcaataatatttaacaaggaagcaatggaccacacatgggaaaggaaagacactgttgtgaaatgttgacaggaatttatttcttgtccgcaaaactggccgaatgatttatatattgtagttaggaatcagacgagaaccttatgacaattgggaacagtatggattatgatgaggaaacaggaagcgtttcagaatatgttatccacatgtattataagggtgacttttaaggaaaaaaagaagtaaacttttcagtggcagtttagaaacagttgaaaacatgcaaatacagttaacagtaagcacagacatatttaagtcaaagctagaagtattttaaagaacctaaatatctatatgtgtgtgtatatatatacatatgtgtgtgtgtgtgtgtgtgtgtgtgtgtgtacacacacatatagtgagagagccaggtgaaatccaaacatcagaatgtcttcaacatttttccagacatcaaaatactcgaacaattttgcctcatgcatcaaaaataagaattctatcttgtctctcttcccactccaaaccacaactctgaaaggattttccaaaaaattgcttttatcatgttacacctgaaccagataaaataaaataaaattaaattaaaataagcattgatggcagcatatctcaccactctaccacatcaggtctatgatcgccaggtagggctctattccaacatgcttgtcaatatatgattctcttaaactctatatgaatacattttcttcagtttctacttgcagttcttctgcagggggctcagattaaaggatctgggtggagggacaatttctataaatatcatctttatcaccccatccctactggcaccacattcactcctgttactactaatactacgatcatgaagcttacttttaaaatttgaactagctttctccaatcctttcaactttagccaaaaataaaagcctcataacaaactgacccattagggaggttcatcaattattacttaaaaaggtcctaaaaatctcggtttaagttggaattccttctacaacttattatgttaaatttaattgttgacatgctcatctttttttattagactataaaatttcaatggcagaaattatgtgttgttaatttctcttcctcagtgcccagctaatacttaggaaagcatgttatataaaacaacaagtcatcaacaggcatatatgttacaaaaaaactcaaggcaaggaaaataaagaaacacaagtgggtttttggcatgtcattttcaggaaaaagcagtgagtagatcggtttttctaaaatgaagccctctgagttggcatgtagagagagaaagaattgaggtggctgttaggatgttgcctacaggctgttaattatcgccttatttgaaataatcattttactattcagaacattaatttaattttaatggactgacattatgatggtttaattgaggttaaacagtgaagtcttatatttaattaaaagtaaaaaaacctattatagagtattataaaaaccctgtatgtgcctgccaatttttaccccaagaattagctagaaactctcttttcaattgacagtgaaaatttgttctgcaatatctatttggttttacgtatttgttttaaagagtatattcagagagtttcagagaaaagtactaggccaattaattggcaaattcaaaacttcagagttttggccctgcccttcagccccactgcaaaaacctttatctatacttataatggacttttcactgcagctgaacaaaaatgccgcatcttggtaccttatgcatgattttcttatcctaagatatctgtgtatagcttagaagctttgtcttttgacagtaactacatgacattcatcgaatctggtggaattggtaaaataagaatattgtatctctaccaagagagtatcagtgactaaatcttatttttcaattttaagtcattattaagatcctaagaaaagcccagccaaaatatggagacagataagaagctctgtggggttctgagagaagagatgaagctggcccaaccattgtctgatttttttgctctccactgagaatgaaacacatggaaataggattgaaaatgaaacaagaatcagcattggactaacacagctggatgttaggcaaatgcttattatgtgtagtgtttacttttccagaggagagggagacagttgtaatacttaagaaccaaacttctagaaatcaaacataattctatttatgcttctccatcccccaaacagtaaagctcacctttgttaatgtttcttgctttctcaactgtgtttcttgcactgtgctaatatgccttttatctacactatgttatttaattcttttatccaccatgtaagtccctcactacaagttctataaggctgtgtaatttgcccaaattcacacagattctaaatggtgaatattgggctcatatccaggtcattccccaaagtctaacctcttaatgactatttcacctgctaatgaatattcctacattaaattataatacttcattgcaagtaggttttttgtgtgtgactgaatccagtggagttaaaagggatcttcaaaaggcactccgagcacccttatagtttcagcaaaatgacatgaaacctctctccttgtacctctcaaaactctcctcctctctaaataaataaataaatggatagaggttttttcattttatagcacaactttctttagttaaccattccaatatttattacctcttctgcttgtgcctgcctccttgtgtgtaattcaataccctcaaaatgcaatttgattcaaacagctggtccagggatgcaaagtgcctgtcttattctgggttgagcgagtgactagccctgggctggctgctgtggcagggcacaaagaaatgacctcagcccataaggagcttaaaaactagtagataaaatgaggcatttacacattcagcatatagaggctatattgcctgtgtgtaatgaagtggtaagttgagtaatagactaatactaaccagatttcagacagcccacttgaagagacaggagtagctgagggtgtcttcctaaatgagatgaacccatcattggccttgaagaaaactagcttttattgaatgctctctatttggcagaaagcgtggtatatggtagatacttcacttatacttgcttatttgatcttcacaaaatgagcattattatctttttatagtttatagaaaatatggttcaaaagaaagtattgactgtgtaaatccacacagtaagtttttgaattaggccctgtccaacttatctgaatctgtccatctatccatccatccccatccatctatcttttttttttttttgctttttgcattactttacaattgcctccatgattgctatatcttgtgcagtaatatttacaatttcttgcacagaatccgttgcttttttgctaatagctcttctgcttttctttgtaggactgtcccacctcagttctcaatgtgtgttcttcaggtagggctgaaatcttcccatcaactctaggggtgaacaatcagcaaaataagcctcgctgaacacagcgattatttcagctggtataattggtcatttatgtgtgttgagagaaaagggccttctttctgttaaggatctcaactctgaaaataggagtccatggtttttagttgccaccttgctaccgaaaaatgagagggtatttgagaaagacatcatcagagaaaaagcaaatgtcaagtgacagggacagaaagatttgggcactagcatttgcttgcctggtcatgcataaattaactttttatttttgtctcaaccagttggatttgatgttctgccatataaaatcaaatgagcccaggcttacatggagggtattccaagaggggttgacaatttggaggtgacaggatgaaccaaggttaatgatgaggaaaatgacacgttttaaatgaaggcattaaaaatgtaaggctaaagtgaagtagaggtgttacataggagacagtagagcccaaatcccttgcactagctttcattctttgcaataaaggagaattcggttgacccatgaggatggtgcagtgacatttaaagcaccacagcaaaaatgcactgaatattaaatgcactgtagaaataatgtgcatcgtatgtttgtgataaaaagaaagataaatataattgtagagactctatcacaaatagaaaatctcctgtgaaatacacttatagaaacggtcaatgttttatgcatattaaaacattctccaagatgatacaactgccagcagcaccatagttcattttaaaagacaaatacattctaaaaataaaataaaactagcaaacacattatttgttcaaatagtattttgaggtcaaccaagatgcacttctagttccttgcaatttgagggatttttataaaacagactttcaattgagattttgagaaacaccaaggcaagttaaaatcttcatgactttattcaacaaaaaggtggcagcaattttttaaattttgtgtgaaaagtcctacaacagcaaaaatgacctataaaatagttcaaataacagcctcatggcaaaatgactttttcattctcctaagaaaagtcaaacaaagtataaatctattcaaacagatggacttaaattgcaagcattaattcaattcaaactttggtgcattgtctaaaaatcgctgttgagaaatagctttaagtctgaattatcaaaattagtaattaaaattcctaaaacaatccaattcaacagttactgagcaattactatgtgccttactctatttagtatttaaaatacaaataaaattcatccagtccaccaaggaatggccttagtatcctcgtctgtcatataggaatgatgatggtactcataggattgttagaatgagtaaattagtttaatatacataaaacacttaaacagtgactggagcttgacaaatactctttagagggtcattattattgctctgtgaataggtatattcacaaaactgtggaagcattgaagaggtaatggttagttctgtcttgggactagaaaagtcttcaccaagaataaataatttaagtaaacctttaaggatgagtagaagttcactaaatgaaaaagtgtgggtggcctctctagggagagactgatgggtcaaaattctagagccacagtagaacttgatatgttcaggaagtgatgaacaggctgcatttgatttgaaagggtactggaattttattctctagggcataggggataatcaaatttgtcttttttggcagactagtggtataacaagaattagttttaaagttgcccctaaattatcatgtgaatattatcatgtgaatatacatgagtagcatcatatgaaattagaagcacctggcttcaaaccccatctgtcacttagtgacttctctttcctgaaaatataaataataatacttaatttggagacctttcacttaaaagagacatttttagactcccatcatgtggcaggcactctgtggtgcttttctatatatatggtgataagtatataagatttttatattataaaagtgtcagacaatatgattactaatgtgttaatatccattttaaagttttttggtttaattaataaacatcaggcttggttacactcattaatgaaagaaaatatgaagcataacataagcaattaaaatagtataacaataggataataaagcacatcatccatcttcaacagccatcaactcacaccaaccttggttcatctgttgctccacttacctcctctactttctggattaaattgaagcaagttccaaagaactattaattcatttgtaaataattaaatatgcatctccaagagataatgactccttgaaaatatcctaatatcacatctaataaggaattaacaataattatgtaatattttcaaatatccagattctgctcaaaattatattaaatttatttgtctgaatcaagattcaagtaagattcatatggtagttggctgacattgctaaagtctttcttgatcttttcatctcttgtttctgtgaaatttttattttgttgttgtattgttgaagacacgaggttgtgtgtccggcagtttcaccaagtgcagattttgcttattatatctttgaggtgtctttaacaagatcttctagccccaatactttctgtcagttgttggttagatctagaggtaggatcaaagttagatatgtctttttaaacaggagtacttcacaggctttgctgtgtatgtttatcaggaggcacactatgttatttgatctttaatcttgagatgattggtaattatcatttaggactgacaaaaaagcaatattttaattctatcatttcttcttcttttaagttgaagtacttctatgaacagaaatcttcccttatcagctacttggttgagatacaacaggtaaattattgataattaccctttatttataagcttttaaaatcgtatgttgatacctcaatagtctccaaaggtaatcaaagagccttttaaaatatcattatgaatgaataaattgagaaatatctgagaacaccaagcttactagagctcagatatttttcatctttgggcagtgaaagctaagtcaggtaggctcttgaatacttttgggaagtttcttgtcaacatataagatattccagactcatgtcatatatttccttctgcagacctagaattcattatttctccaagaagccctgggtttccttttagtggaaaatagaacctatctagagaccaaaatctaggagtgcagaatgcttattgctattgggttgttcattatttctaggtctttacattgacagagcagaggatactttttttttttagaaaataaaatatattataaatttatactgatgactacaattcaaatttagggttacagtattttaatttaccctcatcaatccttcatttttttttttacttctatgtcaaaaatcttggttttcagcaacataaatgtgattactcatttgccttaatccacactacatataaaacactcactacaaaattaccaccaccaatataattatcaaaaacacagtttatggtttatagttcctgaagtttattttgtccttagggtatatctcagtgtagatatacagtgaaaatactgtgctttataatcatttgcaatagttcttccttctatagtaattccaccaactggatatttaatgaagtttatctgttttctttactttcagaatttagatattgtttttcaaatctaaattacatttaataatcacataaactatatatgtgaactcagagtcaaatcttcaaagactattgagacatgaaaaatgttggttgagctgccacgtttcaccaagggaatttggcggggtggtcactaaattcatgcatttttgaaatttctagttttagaaaaagactgagggctcacccatctagaagcagatctagtttgagaatgaagaaagttggctggcaccaagcaccaagggacagtagcaatgtgaaaacacttcagaaactgctcagatcatttttgctggaagaaaaagtacactaccaagtaatattttaataggtatttatttcatcggaaattttaaaaaatcagccacaattttcttctacctttgtgaaattttgcgtgtgatttacgagttggcattaagagatcacttaatacttgctgttctgccctattctttggcattctatcataaacattttccgtgtggtagcatattcttcctattttcattttaatggctgcatactatttcatggggtgaatggaccttaatttaattagtctgcactaccgtaaaatatttaggcagttttcccttttcttttttttctgttacaattatcttccagtgaacacacgaagctccataaaagtaattttaagcgctttgctttagctgtggcagcagtcgcaagtcgtatttttgatcatctgggtgcacaatactttaccaggtcttgctcaccagttagataaaatatttgctagttatgatgcaaggaagagcaaaaatagtaaatattattttgaaccagctgccaagagaacagatggaatcccacagtatccaaaacatttgacctgaagttgtcctctgtgaccagatccatttcttctcaaaatacatttttcaagcagtagttccctgaccagtagaaaatgctgcttttatctttctcttcttttgtaaatcatactgtatgctatcttgttaaaacaccccatgccagagaagtatgaatgaataaatcttcctgcagatctaggtttccttcaggcataactaaacctggcaaacacactgttaaaatgaccagccacagcactggaccccaagagagctctatggtcttacataataactgcacaacaatcaaagaggccaatagagggggtgagctgggattttttttaggtagggggagggagcggaagtaaaaacagaagaaaatatgagctgcagggctaattggatgtaatttggagatttcaaagaacactgactacaaggtttgaagaggtgcagtatttttgaatgatgaggcaccagaaactccctaggtagcattttgaatttaatttaaatgagaatccagtatttgtgcaaacctggggctgttaggatgcaagactatcttgggattggcattggcaaaccatgcacagagctgtgatgaagaaaccctgtcagaagacggtgcattatggctttagagagtgaatttctagacagtcaaggttgtgtgaaatggggtactttcagcatccctagagatgatgtcttggttggttggatcttggattttgcagattactgatgaaaacattttttggagatataagggactgaaggcataatatgaaatcttactttcaaaaatttctatcagttaagttcaaagagtcattttggggcttatggggatttataatataagtttgtgacaggtgacattattttcttatactgggccttgaattagattgaataattaactgtgatttaagatttgaagaggccagtattttctaaatactaaaacagtggttttggacgttttatgcttcagagatttaattcctgcaagattaatttctttgtaaaacccaaaaagtatctatattttgaatcagacatccagattctttaggaagcaatttttcaccaaagataattgctgctgagatttaaatggatagaatcctagtcaccttggagcatgaaacatgtctaattgtcccatcattttattagaatattattttatttaaaattttgccaacttcattaagacataaagaccaagtgagaaagagcaattcatctaaaataattagctggaatttttcattcatgggtcttttgccaaccttaatcattaacctggactttaacaacttgtgcattcttgctgacagcctgactctcatcttgaactctccaacccaactgaagtttttttcttgagataaactgcacactgactcttcaagtatctgaacggcgggggaaagcttagacaaatagattagtaacaatgctcaggtgtgttgagaaatgggcgaacgaacggctgtccttgactaactctctggatgctcagagagacatttttattgtttcgtgcagtccttgtttaataccatgttttgaaatacactgcaaagttgacaagacgaacagtggagaggtggaggtcttcttatttctttgtctttgtggcaagtgtcaaatctcactttttccctaagattcctagaatgcacagctaagaggaaacatgagaatttatctagaataatggcttaacaattatttcatcatgacacatgagacagctggtggatcatgttgtgcacctcccatgggttattttaaatagttcctcaggtgtttggaatgcgcagccaaatttgtgaataactggctggtggaaagaagatggcaccatatcctcgttgataagataaaagctttagagtagaaaattgctatcattaattttccttcaaactttctctgccccctcttgcctctaagtcagatcaattgtcagcctgcttctctgccttcgctgaattgacagttgctaacacactgctaatggctaactgggacttattgattacagaaaaacgtttggctcattcaaaatcaaagtgataacatgtttgaaaagatgcttaatatatgtatttaaaaacagctctcacaaaagattggttaagggctttaagatacaaagagctgttattaacaaataaagtggacttgggtcgttaacgggtaatgtataagaaaattaaaatgggtgataacattttaaaagaagtttgcctttattaataataagataaatataatttcaaactataacagcatagcactgtgcattaaatctcatttaattggcaaaagggcaaaaatgatgcctggcagtagtgaaatagtgaggtttctacattgcagaggtgttgctaattggcacagccactctaaagaaagattagacgatatggacctaaattcattaaaatgtgtataccgttgaagcagcatttctagtagttagcataagaaaataatttgtcaaatattcaaagatgtttatacacaaatgttcatagtaactttttaaaatattcaaaataaaaaaaaccctcagtggacaccaatgaataagttttgaatatcctttcaaaagactatgagatagccatgaaaatcaatgatacagatgcaagtgtatctatataaataaatctttaataaatatacagtgttaagtaaaaacaccatactataagaccatatgtatgtacgtatgtgtacatatatacaaatatacatacatatctatgtaacttgataaaatttggacgattataaatgaacatattagcaatatgctccctgagatgatcgttttttctctctctagtgctctatattttataattcacttctaaaattttaaaagaacacattattaaatttctgaaaatgaaaaattcctttactttagacaaatgtaacaagaaattatactatttcaaaacttactggtcgtgacctcttaagagtttatttcagtgtctttgaaaagctcagaaagacaactggaactagaaatataggcaggggttttttattctgtccagttcaggataatactaataaactaaaataattccaacgttataggacaagcaaagtctgatttggaaaggtcagtttatgaaatgagagtcgagttaatagcaattctcttccccctcaccccattccattataatttgatcatttaaatgagaagacaaatatattattattacgaaagatgttattaggattcttcccatctcaagcttggtttaaaccccaagagaatagctgccaaccacatccagattccaaagagaggcctgtgggtgccagattaccaaagcaaggtttaccaatgagatagccaagagccagttttacaacccttaaacccttagctgactgtccacctctgatctatagaagggatttgacagattgagagaatgtggtgtagattacaaaagagttttagaaaagatttgtaaggatactgtgtgcccccaacctctctgcccttctggtccccacccctccctaccatgtgggagggatgaagatgcttctccctgatttcaagtctaaaaatgggagtctcgattgaactatctggaacatttgatatgtgtctccctagagctagggtgctgttgcattggtatctagttgatgcctgagagatcaaaaggcttgagattatggctggccagttattctcattcaggacaaagatttgctgcaaggaaaactgcttaaatgcccagagtttatcagcatatagtttatgttttttagggaccaaatgtgaccaagatgggaggtggggaaggagattctggagttgttttaaagggggtgagaaaacctcaacagaaagagacctgtgttgaatgcctacggctgctgagcagagagtgaggagctggaagaggtcatttgccagctcgcaagtaagatgctggagtttccgacaaacccacacatttgacccactgtgagtcccctctaaaagcatgcctccttccgagacagcaccactcactgcaggccacgttcccctgctctaccccgcctctatcctgaagaaacctgtgaatgagggaggagttaacaggagaaaatgaggagtttttcctcaaggccagagctaaaggaagagacatggtttcactttaaactaagttgagcatttggatgactctgttaatgatctgagagtacttttggggactaaagggactggagaaatctttatgatctgagaatgaccagaaaactcacagggcctgcctgcgtgtccagtgtcaggaaaaagactagcgaaagactctctctcctttatttgtatttatcatttaaactaaatcatacatatcaagacacttcacttctaaaatgtaccatgcacctcttaagaatagggacaattgctttcaggaccacactaccattattgggactaaaaaaaaatcaattatcaataatttccaatcatctagtgtctggtatatatgcaaaatttcccaaatgttgcaccagtgtctttgtagctgttgtcatttattcacttatgtatttaattagtatctaatctggttctaattatgtttctttagtctcttttggtctagaatattccattcgttgctttttattccactccattttttaaaaatccaggatattctttttatagaatatcccataatttgtatttggttgattgtttcatcttgttgcaattaaatatcttcttctatcccttatattttctgtaagcttaaataagttagcttcgggttaaatattttttctctgtcttttttgcaagaatagataattgggaatgctttcttattatgtcatatcagattgttctgatattagatatctaagtgtatccacttggctaatattgttactttacagtttttcctttgtagttcataagaaatctaattctgtggttggggaattgtgagtactctgctcccgaaccatttctcaactaatggttttagcactcattaatgatacattcttaataaattacaatactatggacttgaaaaatggtaattttataagtactatatatatatatttgtatttatcagagagtttttctctaaaagaagtttcctttttgttttccttttcttttgtttgagcataactgtgtaactatggacttagggttttttttttttttttttttttttttggagaaggagtcttgctctgtcacccaggctggagtgtagtggtgcgatctcggctcactgcaagctctgcgtcctgggttcatgccattctcctgcctcagcctcccgaatagctgggactacaggctcccaccaccatgcccagctaattttttgtatttttagtagagacagagtttcaccgtgttagccaggatggtctcgatctcctgaccttgtgatccacctgcctgggcctcccaaagtgctgggattacaggcgtgagccactgtgcccggccagggggttttaatttatatcaatgggtttcaattaattaccattgtgattacttttgctgctaaaattatcccaaatttgacaaggaatgttccttcaggctggctcttacatccatttttgagaggcctaataaatacttgctctctcacttattccaggatctccttaccttacaaacctcagacatagaattagctatttctccatatagctctggttcttttcatgggcaatcatatttagaaaacaaaatctgggtgctagatgtgcttactgctattgggatgtcattgcttctaagtctttttagtgggcagaactagaagatatattaaaatggaaatcaattactttgcattgatattttcattaaaaatttaacattatagatttgttttctcctaactttatttatttcatattggtttttctttctttttttttttttttttttttttgacagagtctcgctctatcacccaggctggagtgcagtggcacgatctcggttcactgcaacctccacctcccagattcaagtgattctcctgccttagcctctcaagtagctgggattataggcatgcaccatcacatccagcaaattttttgtatttttttagtagagacagggtttctccatgttggccaggcagtctcaaactcttgacctcaggtgatctgcctgccttggcctcccaaagtgctcggattacaggcatgagccaccgcacctggccagctggtttttctttttattacactgaagatctaactttttgtggattttattttattttttatttattattattttttgagatggagtctcatgtgtcacccagactagagtgcaatggtgggaccttggctcactgcaacctccgcctcctgagttgaagcaattctcctgcctcagcctcccgattagctggattacaggtgcacaccaccatgtctggctaatttttttgtatttttagtacagatggggtttccttatgttagccagactggtcttgaactcctgacctcaagtgatccgctggccttagcctcacaaagtgctaggattacagtcatgagctgccaagcccggcctttttgtggattttaattgtcttaatgggttacaatttgctttatcctaattgtttatatgtgtgtattactattaaatttactgagtgaaatttagatacaacatcttcttggaatacaagctttgcagatagatttaaaaatataccccactaaaatgtagaggtaatactgtcttcaacagatatttgaaacaattctttaatctgcatggtcttatcaattaagttcatttggtaaaccaaatgaattgataaaaccatgcagattttggcacttctgcctgtgttttatcatctgctatctttttcttttaggtaagattttgtttctcaaatatgaaaagcttttacatagttcaaaagttaaatgaatataaaaagtatattcagagaggtctcattcctatcctgtcctttctacccaagtccctatccttatacagagccatttttttaagtttttttttatttgtcttttcctattaccctatcattaattggtgaatgaggcagaggagttatttgcctgaacacacatggccacagagtggaggagataggatttaacccagagcagtctggttgcagaagtaaacccttagctactttgcaaacggcctattaaagtaagactgtgggggaagacaggctttgaaattagcaggttttatcacttgctatctgggtgactttgagcaaattccttaacttctctgaggtttattttacccacttatgaattagggataataatgtttactttgcagagcgtaacaaagaatagagataacttaagcaaattaagttgtagattgtcaggcacatagtaattactcagtgaatgttacccattattataactagtaaaactataatagtacgactcatacagaagaacactagaaacttttattgttcagttgtcactgaagtatgtgttgatctgatctatgttatttagtaagattaaaattttctaagagttgatgaacttgaacaaaaagcaaacaagcctgggtttgataatttatggtttcaaaaatgttaaaataatctcagagggctttgctgattttggttcatttttcaaaatagaagtttcaatattttagtggaaaagaatgttttactactactagaagtcatatagaaacaataaggtaatttctagctgaagtgagttttacgtaaacttgtttaacttcctcattgttttttttttctgtttgcaatataagatattcttatgctcctcatgttttaaagaatttttattctgtgttgaacacaaagaagtttgaaccatgcagaggttgaatttaatttgtataaaatcctcttaatagcatggtctaattaagacacccattacattcatggaatgctaatttaatttggagggaaatgtagttgagcactattgggtttaccataaaattaacacagtggacataaaatggatgtgcttattagatattgttatcagaaatattatatgaatgaaaatcacaatactgctatcttgatggaaataattgttttacagaataaggcatactgtgtgattaactagctaatttatatgaagctatatgagcaagactgttagtgaccgcttttctgaagacaaagattattcaatcgtttttttctgacattagtaaatgccttggcccctgccttagagagtttgttatattggtgaaatttatcatggtagattgaacacattgacttgtattaaggcagcagatctcaaactttttatctcaaaatctttatacccttaaaaattgttcaggactccaaagactttttattgatgtgagttatatccattgctacttacataaaaaattaaaatgaagacattttaaaaatatttttaatttatttaaaatagcaacaataaaatctcatatgttagcataagtagcatagttttttaaaacatgaggatattccaaatgttgacagacttcattgcaaattgtaagaaaattacatttgttaatatcacattcttgaacatctataattactgagaagctttcaatgtgttggtgaaagacacacgtttcagaatttgactttttgcttaaaagctgccagttattttcttcaaagtgacagattcactcattcatttttttaagaaagtgtctgctgagtacttgagtctaaccatagtttattagtcattctttcaataaaaatcatgttaatgtaaaaagcagatagttcatttcacaagtcaaacatttgcacaaatatttttccttgaaataatcactgtgctttgatatgcagcagaactgctttatataaacttcccattttgtcacagagaatattaaaaagatgtgcaacaagtagttgatatgtaaataaacctaataatttttatagcttcaacaagaacattcttatataacattggcattttctcctgcctgcaggcgagtggccttgaaaaataccttgattgctggaagagttcagtgccaaatattcggtgccaaagacactagcagttctacccaaaattccttttgcatcattggcaccaatgccaatacagtgaaaaagtcaaataatgtcctagaattattaggaaaactgtttagaccttgaggaacactacaaagtgtcttggagatccccagggctctgtggactatactctgggaacgctgtagtaagatccatgtttgctcagatgtccttgaatcaggacagagaaagcatttacaaagaaaggtggctctgtttctgctacggatgcagactactctccatgctccctgagaatttggggtactatgagcctttgtaggaagatgcaaaacttttctggccccaaatcccaacagtatacctccttagatggtttttgatataagacttttgtgtcacaaacagtccataaagagggattcactttgaatatttggatggtggaggaagtgagggtgggtagaatatgtaaagaggctcaaatcacaaatcacacaatggtggaacttttgctatcgccacatacttggaaagatgactggagatacaaatatagaaggaaccatttgcaaactaacatagtacaaattgtacttttcttaattctttggattttattatttactttttgaagaacattgttttactttggctaatttgaacaagatatttgttacaaatgggatgagattctaatatcttgtattttaagatccctaaataagcaaggttttgtttcaaatatttagccttggaataaaacgttaacacagtataatataaataattatatttcgttaatgctttttaccacataggtgatgattaagggatgaaaagggattttcattcaggataagctgtttacaagattgaagactttaggaggatcatctgatctgttaccctcactattgtcctccaatccacacaggaattggttgagcataattcagagcaggctgtcaggggaacgactggggcccagaagctaattaatacaaatcacacttaagattttatttcaagtgctgtgcagaagctctttagtttaattaggtcctacttgtcagtttttgtttttgtttcagttgcttttgaggacttagccaaaaattctttgccaaggctgatgtcaagaagggtattttctaggttttcttctagaatttttatagtttgaggtctcacatttaaatctttaatccatcttgagttaatttttatatgtgctgacaggtgggggtctagttttattctcttgcatatggctagcctgctatcccagcaccatttattaaatagggagtccttttcacattgctcatttttgtcaactttgtcaaagatcagatggctgtatgtgtgcggtcttatttctaggttttccgttctgttccattggtctgtatgtctgtttttgtaccagtgccatgctgttttggttactgtagcgctgtagtatagtttgaagttgggtagggtgatgtctccagctttgctctttttgcttaggaatactttggctattcaggttcctttctggttccatataaattttagaatagtttttcttattctgagaaaaatcatattggtagtttgataggaataatgttaagtctgtaaattgctttgggcagtatggccattttaataatattcttctaatcaatgagcatggaatgttttccatttatttgcatcatttctgatttttttcagcagtgttttgtagttctccttgtagagatccttcatctccttggttagctgtattcttaggtatgtccatttttttgcagctattgtaaatgagatgtgttcttgatttgaatctcagtttgaacattattcgtctaaagaaatgctactgatttctgcacaacaaaagaaactgtcaacagagtaaacaacctacagaataggagaaaatatttgcaaaccatacatctaacgaaggactaaaatccagaatctataagaaacgtaggcaaaaaacaaataatcccatcaaaaaaatgggcaaagggcatgaacagacacttctctaaagaagacatataagtggccaacaaaagtgaagcaaaatgttcatcatcactaattatcagagaaatgcaactcagaaccacagtgtgataccatctcccactagtcagagtgacttttattaaaaagccaaataataacagatgctggtaaggctgtggggaaaagggaatgcttatacacagtggtgggaatgtaaattagttcagccactgtgaactaatttgtaaactccagtttggagttttctcaaagaacttaaaacagaagtacggttagacccagaaatccaattactgtgtatatatccaaaataacataaatttttgtaccaaaaaggaacatgcaccactttgttcatcgtagcactatttacaatagcaaaaccataggagcaagttaggcgcccatgagtggattggataatgaaaatatggtaaatatattaccatggaatactacacagccataaaaagtaataaaatcatgctctttgaagcaacatggatgtgctggagaccctaatcctaaacaatttagtgtaggaacacaaaaccaaatactgcgtgttctcacttatagtgtatattagtctgttctcacactgctaataaagacatacataagactgggtaatttataaaggaaagaggtttaattgactcacagttccacatggctgcagaggcctcacaatcatagctgaaggtgaatgaggagcaaagtcatgtcttacatggcggcaggcaagagagtgtgtgcagagaaacgctcctttataaaaccatcagatctcatgacacttactccccatcgtgaaaacagcatgggaaagatctgtccccatgattcagttaccttccactgggtccctcccatgacatgtgggaattatgggagctagtcaagataagatttgggtggggacacagccaaactatatcacagtagaagctaaacattgggtactcatggacataaacatgggaacaatagacattagagacacctagagtagggagagagggagggggacatgggttgaaaaactacttattgagtactgtgcttagcacctgggtgacagtttccataccccaaacctcagcatcatgcaatatacgcatttaacaaacctgcacatgtacccctttatctaaaataaaagttgaaattatattaaaaattatttcataaaacaagcaagttgtcaatttgcaaagaatatttcaagtttaaggcctttattctgtactaggatcttcaaaagatactagacaatttattttttcttttatcaagttattaccttaacatagattgttttcttagttgtgaaataattgtaaattccatgtatttcttttgggggataaatgaaatttcaaatggatttctattggaatcagttgacatctggaattaaaatcttgctgaagtttctgtgattccatctaagatactagattttctttgattttttttgttcttcactgtttctaaagcaattatggtagaaacaagactaaatgatagaagataaatgagacaaataggatgtagttaccagaacattggattgtgcaaaatggaacatttcagctgctatttctatcactagaacattatgacttcatgtggattttagaaaagtaataggtaaacgattccctagctcaagaatctctgaggacagctgaaggcctggagaccaacaataactagagggattcagatgggtgctgggcttgcttgctgaagcgtgcttggctgtgtcctggaacgctgagtagagtctgaagctggtcagagaaggtcataccctatttggcttttgctgttgtaatcttagaatcatgttttcccttattctaacagcttatcttccttgcccattttattagatgccaaactcatataatttttttaacctctaaatatctacttgtataggacaaaaataaactttcagcagccatagtgtatgaaggagtatctgtgattcttccatagtgtagataaagagaactagagaggatacacctcgtcatgcctcaggtcaagtcagcctcccctaaggctctagcggccatcagattgtagtggttatttcctgttccctcctgtctctgtcctccctccccttcatcagggcagcctgctgttcctcgacatcatggatgttgatggtagccccagctttgattgtctttctaccagtcaaccacgcaaagaaggagggagaaaactcttttggagaattccttggcccaatggaccaggcatctcttttcctcagctaagctttccttcttggtatgttacagggaaaggggaagcagtttgccagacagcaagtcaacccggtcttggaatgaggggaaggaggtttccctcggtcccagtaacactctagcagggccaagcattgaaggagtctgcattcaacttgcagaatctgtttagcactttctacacctccatcaggatgtattttattctctggttttagtttcctatctggtttgaagaggagaaaaataaaagtcatgaaacatatagcaagcacctgctccctttgacataagtcagcttgttcaattctcacaacaatcctataaaagagctgctattattcccatttaataacaataaaacggtggctcagagaaggtaaacatttttctaagttcttatacttaataaatctaaatccaaatttgtttttcattcttctttccatatcacactgctatatagttactatgttatcatctcacaatcactgatcaactccgacctttgtcttttttcctgataagtcaccttgttcttggcattgctttccatattcgtggctagcagtgtccttcccagggttagaggcaatgatgagttctttttcttgtgattgctcagtagaaaaggcacgaatggtgctgcaaacctaagacacctccaaacgttatacacttttgctaatagcaggaaaaatgacctctggatgctgccaaagtgagcactgcctttacgtatgatagaaaatacaattatacattttaaaatgatctcacagtcttgctttctaacttgaattcactgtcatttaactgatttataaggattcttggccacaactaaagtatattttaaacttataagtattctctaatgaggaacttttaaaagtccagataaaagcccactattcagtagttagaataattcagtgaaattaaccatgtaaatgctcaatgaagcaaatgattaaagaaggaatgaataaaaataaagattaaagtggatcaaattatattttgtctttttttatactgcttatagatcataattaaatagtggtggctcaaaagcacaaaaccaacctcatcacttaccaggtgtgaaaataatgttgatgtgtatgcttagttttagcgtgacaaagcagatacactttttcacttttaaaaaaaatcactcaatgcatcattctttaatgtttgcttttgtgatgatcactgaatatagaaagtcttttgattttagaataattttaagtctttgcctgctgataacctcagacacagacctgcagccagaattggttgagagttctgctatcttctccaatgagggatatttgagtatatactaaataatcatatttatatactggcatttaaaaaaccaaatattctcatagttctcttcaacctcctgagctccttaatatagataatatagatggccacatttttgtcattatacagtcatgaaaagaagcctatgtaggtcttatccacatttacaagacaggaactgaagatcaaagaggttaagtgactttcttaagttcctcagataaacattttgaaacagctgagatgaaatacaggtgcgctgacttcaaagcacaagttcttttctctagagtgcactacccccaatgagttgacaaaattaaacaaaaactaagcagaattatattttcttacacatacttcatacaagtaatcattaagcagctacttggtactaaagtttctcccaggaggttgcagtgcagatgggtaagtaagctgctgtatgtgcccccaggccataggcatgtcagcagctatggataccacagtaaaataaatgactatcgagaaagcaggaggaacagctcaccaggggagcacagtgatgaagtgaaagcttcacctttcaggaattctacacagcccataaaaaaaaaaactctatcccctccctttcagagtgtttcttaacaactgcttaacacagaaatcatcaacgtattgttgtagatactgggattaatatgtgcagaacttcaaacagaacccagatctcatgactccaagtagaggacctgttccaataacccatgaaaataatcacaacatcctaatcatgttttcatccctgttttactttattagttgttaataggtccattggtcactgggacacccacatgggggttatatacctgttcatacacaagctatgagtctttgaagacagaagcatatgaggtcctgattttgctctagtatgaactcaaacaaattttttttcagactagtcaccctcatctttcaaaacatcagatcatttcagagctgcttctaggacatgtgaacttgggcagagagaattgctttttcttcactgtgttactgtagtgtaccagtcatatggctattctaagatctttaatcctcacttccttgtcaccctcatgaagggtccttcaaacttcttgatgacagccaggggcagggagggcactccaggcagcaagctgacacaatttacaaaagcagttatcttctctcccgtgaagcaatgccgcctggtagaacaaatggtgcaacccatgcacacttagtttatccaccttgataatctaagtgtcaaggacagagcaagtaccattcataagactctctggagcatgcaggatactgacaagctttttatttatgacccagggtttaacccatgtgagctcatactttgtcttctgctaagccttccatagctccatctcaagtcctcctttaaggtgagggtcactggactgcatatcattcagttcccagctagttttctcttcatttatttgtgattttactcagattatgatattattagtttagaaggggttgctgtagtcaggacaatcagtaatgcacttctaaatactaggtagatcctccattctttgtggttaaactccttccaggttctagtttgtttgtttatttatttattggaagattcatacactttgcctttcttttcaccaccttggtttggtttacaagaaccaaagctagtttctctaaacccacttgattagtgtgtgtttgtgtgtgtgtgtatgtgtgtgtgtgtatgtgtgtatatatatatgtgtgtgtatatatatatatatatttttttttttttttttgagacagagtcttgcgttgtcatccaggctggagtgcagtggcatgatctcggctcactgcaacctccacctcccaggttccagcgattctcctgcctcagcctcccaagtagctgggattacaggtgcccgccaccatgcccagctatttttttttttttttgtatttttagtagagatggggttttactatgttggccaggctggtctcaaactcctgacttcgtgaactgcctgcctcggcctcccaaagtgctgggattacaggtgtgagccagcgcgcctggcttgattaatatattttatttctactacatcagacacagattctttttgcccaacatacataaccatgtagtcctacctaatatagtttcctctgtgtgtgtctgtgtgtgtgtgtgtgtgtgtgtctgtgtgtgtgtgtattatatatacaactagtaggaaaccccacatatccacatatctttctagatatcttatctccctattacaaaactcctctctcttgattattacactttataattttactccctatgtcatccaaagtgggactctcattgctgatggtctaagtcagtgagaccctgttgccttggccatatcagagtctctggatgcagggccctggaatcaccattttttaaaagctatgcagtgatgttactgtgaagccaggttcacattttcagcctttagaaaaggcctgttgacctaagttggagaatgctagccttgtccccaaaattgcctgtcttctgtagttattcagtcaatatttattggcaacaatcatgcaataagcaactcaaatgaaatatcctggctaatgtgggaccactctggcacctctgaagttagaggacgtgctactaacatttatcatttcagatctttctgatcgagtgggtaaaaaaagatactggaccattttagttgctatttcactgattttctgagactaggcaaacaaatacacaaagttttctccctccttctgctgttcagtcatcacaaagaaaaattaaggcctttgtatatactgagcaaactgttggggtaaagttataaaaatggcagacagatcttactttgccaaattaagacatttagcaagtattgtaagtgtgatgagtgacgggaataagtgcgggacacacttgctttgtctgacagatgtactaacctgattttgatctgccagagtacaggattcattccttccaggtgcattattccaaagtgcttttggctaaaaggcctcttaaaacctcaatttattgttctctatatagtatatttctatttgccatctctccattattttcacagctatcttgtgtcctaagttgggccctaagaaaaacaaactgtcctaaaccataggccaagatacctgaagaactgaggtggtagggcatggattttgggaaaacttttttatggaaatctctgtcttggaatttctctcaattagcagttcttgtactgtttacagcacgagaactgaaagcataacctgcttctcttatgaggtaaactgcatattctgggtgaatgttttctctccacaaaagccatttcacatgtttccagatcaattttgaagttgttttgacactttacacactttattttaaccttttgtttctgagtgtagtatcctcacctgtctacagcatgaggaattgaaggctctaccctgtctgtttgcctggcagagctggggtgactctgctgcttacacaccagccttcccactagactgaagcttgccaaggcaagggctctgaatgtggaagtgtttccctttccagggccctaaatatttctaacttgtatggcacctgggaacaaatcaaattatcttcttgactccaaatgaacctccaggccttcttagaaaagctgaaagaggaattaaagggggataatggctcatgcctgtaatctcagcactttgggaggcaaggcaggcggatcatgaggtcaggagtttgagaccagcctgaccaacatggtgaaaccctgtctctactaaaaatacaaaaactagctgggcgtggtggcatgcacctgtaatcccagctactcaggaggccgaggcaggagaattgcttgaacccaggaggcggaggttgcagtgagctgagattgtgtcactgcactccagcctgggtgacagagcaagcctcagtctcaaataaataaataaataaataaataaataaataaataaaaagggggagaggggatcaaaagcactagtctgcatccattcagagctatgtgtgcaatggggagtaaagccagcctagaacctgtgcatcatcccaggtgtgtttccagtcctcccttcccaccatgagacaaaatgaatggagacaaatttagatcctctaaaatgagaacaggaggccaaaatggtgggaatatataaacgacaagggcacatatcacttgctttactttagtcctgagatgcccaaggccagactccatggatgagtcttggggcacttttggtcccactctcttagccgtctcccagttcctgcaattcagaggaactccccaaattaattaatctgatgaactctgttctcgagatgacagtatctccatattatctgttcccaagtttcctttcaaaagggacaaatgaacaaggaggagacagcactaagtcctactcatttccaagtaaagcatatatatgctatttcccagcttgggggcaggctgggcaccctttcagtattttatgtctgcatctttgaatgagtctggttgttctctcaagggagttttactttatggctgaaaggaaacctgaagctgatttcttggcctttctctttaactcattcctctttctcccaccaaggtgtctgtaaagattctctctggaattgcctcgcttcctaaaagatattttaaacactaggagtagtgaatgcctactcattttatcaaggaggaaactgaaattcaaatcagaggagggccttgactaaagtcccatggacagttagtcacagttcacacaatggaagtccaagcccagttcactttctgctacactgccttgcttgccataacatcatctttcaattagccgtggtcgttgcctcctatgtatattcaacagaatcctgaagaaagcaagctgaacacgtttccaaattagcgagagcagctctgaataagaagaaaattcatggtaagtttatgggatggctccaggtgtccatctttctatcttcccttgttatcactttccctgttttgggtgtagggggagaaagaatttcccattggctgtctcctggggtgagcaaaaactgaatgtgtttaatctaggttttcctcagattccacgacttgtaataagcacatctttatactcttacctctccagctgttctctgtgcaaagctgaactaactaaaactgctgaaaataccagagctatttagggaatttccctaactgcttcaacattcttaaagtgactaatttaattggatttatagggcactacataataatgatatcctttggctatgttcttagtgggttctacacctgtaatgaaatccataatgaaaaggaaaacagaagtacatttgggatgcaaaaccacttaatttcctggacagccattaaaaatgtggcatccagtgcaataccttaactttgattttaccttcagacacctatgatgatgattctggttgttggttgtgggacattagaataattgtgtcagaagaattcccatcgcatcctagattcacacagcatttctcttactggaaacccaattcattagtcatctgagttggaaaactgggactctaacactggatgttgattttatttatttaatcttttgtgttctggtcttatttctgttgtatttggggggtcctgtctgctatctcctgttcctggtgttgaggtgtagtgttctatggcatttctgcatgtccttggactattttccaaggaatatttgtttaacaaacatccttcaaagatagaggcagtataaccatgaaatgtctccctccagggcaaggttagacaggtttgcttgaagctcccttcatagattgttttctagctttgggatttcttggttttggcaaaatatctatcctgtgagttgtatcaccctgagtccacttctacgtgactcccactctcgtcctccccatgacacttgagtgacaagggcaactgatcaaaacagaaagctcatgctgcctcctgtgttctccttaataaagttcattgtctctgatccaggagtctcatgtcttctgagatcatctatgaaactagcaggttaacttgttggctagcaagtagggttaaatctcagacccttcacagttcttgacacccaatttcttcttttttggagccttagccttagatctagatgattaagtcctgctacatgatcttcatcccagtatttctcccttgcttaagtggctcagcccatatttccagtaccagttcccactaaattacccactaaatgtggttccctccctgtggtcacaaggaaatagagaatttttgtagttctctagaatgggcaggacagacatatttgaatgtatttgcccattctaattatttgatagtgacagtctagggcttatgatggagggattcagtcgttgtatctaaattcagggtgaaaggattgcatgatcaataggtaggtataagaaatggtctagatacttaaagtccaaaacatctgcatcagggctccagagtcaggtgcacccaatgctaaatgatatgaagaactggtaattagagtggtacatacatacaaagtgagctatttttgatgatagtgaagccactatccatttaagtaggtaactactctggttatcacagaggaaaatgtgggaaaatatgccaaattttctccaatcctttctgtaattcctctgtagacgtgcaagtatgatccttctcatgaggtttaagggtggaaaagcacaactaacgtgggcattagtgctataaagccactgttaatttaacaagtttatagaatgtgctggtaatttacaaagtttaaaatggtgacatttctgtctattttccagtaccaggaaaatctgtaagtctcctgaacatttaactttttaaaaataaaaactgtggtacttgttattaacatattctttgctttgcctgttagaaaacctaggaggaattttttctattaaccagaaacagttctcaaactctgatacacattagaaacaccagaaaaatcttaaaattactgatacttgggtttcgccaccccagattctcacttaattggtatgtaatggatcctgagattttttttttcttttttttttgagatggagtcttgctctgtcacccaggctggagtgcagtggcgagatctcggctcactgcaacctccgcctcccgggttcacgccattctcctgcctgattctcccgagtagctgggactacaggcacccgccaccatgcccggctaattttttttctgtatttttagtagagacggggtttcactgtgttagccaggatggtctcgatctcctgacctcatgatcggcccgcctcggcctcccaaagtgctgggatggatcctgagattttttgaaagttcatcatacaattaaaatatgaagcaatgatttgaaaaacactattttataggattttaaactgtctagaattcagttttggactagtatatagtagggatcaaacttttattttcccaaatagccaacttttccaatgttatttatatcttctacttttatttagtagtttttttttcatcattgatctttaaaatgatatccttataaattccatatatctgaatctgtttctggattctctatgttttccacttggtttatttgacaactttttaaccagtatcacaccatttaaattactgcagatttatggagtgttataataactaggagaacaagttttgccttattgcactattttttcaaaatattattggccatgttatacattttatttttcagagaaaaatgtaggagatttcgatcaagtttcatcgtctgatgttttgggccatagggaaccagtcagtctctgtattccagtttgtgaagtacggtgttttgattggtcacacctgagtcttatgatctaaccttggagcaccgtctgagagcacacgatgtgagaacaagaaaggtggttttgggagatagaatgtggtgtcagaactatagagtgagaaaaattagagatggggatcctgttaccttgaagggcagggatgcctgttttgatgcctgaagcatccaaacccagcaatatccctaattttattttgcttttatggtaccaagaatgagtccaggagataattttaaatggtagtgctccaaaaagtgatacatgtacgctacatgaagtggttacaaatgaactattgttgttcatgaactccacatacccatcattaagtgtgcttttcaatactgcattactgtggctgccttcaagattgtgctgtaaaatttccctacattaacttttcacttattcagagcatcccattagtttacatgagagaaaaggaattagaaagataaggagtctaagaaaccttaatagatgggagaattctattaagtaagcataatcaggcaaggagtctcttggaattgaattggaatttcaaggtcacaagtcctatcaatccgctccctctaaaatcaccttctcatcatcctagcagatgagtcctccatccccacatcctacataactgcttcaataaactctcattaaggattccattgaagataccatgttttttcctatctcagggccttggtacatactctttttactgcctaaaaattccctcaccttctttttttccttttgtctagctaactataactcatacattcaatattttcctggtagtattttcttagaaatacttagggagcttagagtgacattcaagctccttcatagtttgactaccacctatgtattgttttggtctatctcctagtaagccaggctagtcacctaaatgccctcctttctcctattgtttatggttgtgtcacttgcatacattacctgcttgtagagcagccctcccactcaggagtaataggttttattcctacgaactaacatgcacttgacttgtacttagtcacattttgactagaattacagggacttgaaggtatgtgttgtgtctggatctgcccatatgttcaaggtatttcttccaagtaagtctgcattactccagggtaagcgccagacttcctcatttttctacctttcatggaacttttgcgtgagtggcaaggaatactcaatggcagtgtttctcaagctttaccctcatcaaaatgacctggagaccttgctaaaacacgattgttgcaaccacccctcataccctgtacccaccaagcctaaatccatctcagatggagcccaagaatttgcatttcttataagctccagtgatatttaggctgccagtgctaaaatcacactttgaaaaccactattccgtgacactgttttaaaaactggttgcatgttaaaatctcctagaaacggttaattaagattttttttttaaagactgtgcttgggctcccctctagacaaatcaagatctctgaggatgccacttttctcatgaaaagaaaaaaattcaacaatccgcaactgttaggagattttaatatgcagctagtgttgaaaatcactgttcatacaaatggcagatgagtaagcagagtcatgaacaagagagcaggcttgctgggagcctaggccagagcaaatgtcataacctcctgaggcagcgtgagttagggcatgcatctcacattttaatgtgcttgcccggaagatgacgatagtaaatctgggatgtctctgaaatgctgctggtctaacaagctcccagatgattcctatccgtgaaccccactctgattagcaaagttgggatatccatgaagaaaaaagggtcagtgcgtgcaagggatgacaaaggcaggtgagtgaaatggggcttgagagcccacatccggtaatcctttagaatttcaaacataagaaagaaggggaagtgctggggggtgggttcccctgtggaggaagttacttctaagccatcagtttaagactttaagtgaatttctggggaaagcatccagttttgataagtctggcccagactaaatatataatttctacctaattaaggaggcaggcacacaggcaaaaaggtaaatgcagcttctggaggcacatcctaacagaaccccagagaaattttatcaaagtctgtgggctttctccatcttcttagctgccttcattgagaagtaaatttccatgggagaaaattagggttttgcttcattcccagtagctggcattaaattagtcctgtagaatgtgtttggagatcatgttgatgagcagagattgtctaagcagcaggtgttacgaattcatttaatcatttaaccacacaccctgcacatatttcagctttcttaggttgacttttatttgcaaaacacctatctgaaggtgtgttatagtggatgtataattgatggtgcttgtcgaattttatgctctataaatgccagatacattttccccaagtatgctctttcttgatccatttctctaaagtaaacatttgaaacaaatttaactcttgagggattctggcaggactcactttctcactgattttagagcttgtgttcaggttggggagagagcattatagtttccagactcagctcagtgtaaaaccatcgtgcccagacaactcacttaaaaggaacaggaaagtgcagttagagagcctttactccacccatctagatgccaggctaccaccaatgggcatcttgttttccctcttttctctctcattggaagagagagagagagagagagaaagagagagagagagagagtgtgtgtgtgtgtgtgtgtgtgtgtgtgtgttttactacctgtagtagtttgaatggtgacctggtgaccctcaaaaaggtatgtctgcatcttgaaacctgtgactatgaccttatttggaaaaagtgtcttttgcagacgtaattagagatcttaagacaagatcatcttagattatccaggtggattctaattccaaggctaactgtccttataagacacaaaagaggagaaggccacatgatgctggaggcagagatgagagtgatgcacctgtagccctagaagcctccagacctggaagaggcaagggacggaatttccctggagcctctggagaaggaaactttgtggagcctgtggaaaccgattttggacttctatcctccaggattgtgacagaataaatttccatttttctaaaagtcacccagtttgtagtaatttgttatagcaaacccaagaaaatgaatatactatgcatcagcttggggtcgggaggtggggcacagaaaaagaaaacaagttcccaggccctcctaaaagtcattttgtttaacatttgatccatgcatttgtcatgccctccaaaggggacttctgcagaaaagttctcagtgtccttcaataagatagagcctttctttgctcctaccctaaccttgaatcaaatacagcttggtgggccctgacgctagaggaattctcagtggctgggctggcggagagctatctatttgtgtatagggttgcagccaaagtctttaaactaaaactaaaactctgtggattaaataaaatactggacatgcaaaagaagattctcttcgggaatccctgtgtactagcccctctgtgtagtgaatgctatcactttttcttctcgcttttctagataggcatctagaaaggtgttcaatctcttgggggtaatccataggcctccagggttatttccaaaagtcttgttgatgttatcagtgttaacacagaacctcttctgattagtgttcaatcttactatggaatagcttttttctctcaaatattattagaaaattagtaaaacataaaaatgatcaggtttggccagttttacccctactgtcctactgctattcaaagacctagcacttctgtacatacgagtaaactgcactcgaaatggtattctctgtttctgcttctacttaggttccaaggcaggtaagcagtctaaccagatgacaggtgagcaatctgaggtgaagtgacttcccattacatgacttttgacccccatcgttgtcttggaaatactttatgctaagtattagaaagaaggaaaacctactggctgttgcaaacaatttaaaataacttaaagtggaagaaagaagaaaaaagcagagtgaaattttatagggtggggaaaacctggaggaaactttcctttgaaagccaggagtccaaactatagataggatagtacagaaattcagcaatccccaagtgttctagcagaatttaaaacagaggatgaaacttggagaactctgggctagttgtgaccttcagatatactttaaaaaaatcaactaatattttaaaatcagtattttcacataagattatgactttttttttcttttgaaaattttgtaagatctggcagcattgggcctttattgctgcattgtcaggaactgggctatgggtgttccttccagttgagggctgtttgaggtctactctgtcatctacctggccagtcccagcaaagctggatgtagttaaacatggaaggcacaactggactaggggaattggataagtccttgaacaagtacctgagttaaaacatcataagttaaaaggaggggatactggtgtgagttctgtttctcaaaaatgggtgtggagttctaaaattaatgttaatttgggttccattttttccaatttccccactctctgccatattgtattctttgacttagcattagacttagataagttagttaatattcctgtaacttcggtgcttcatacacaaaatgggaacaattataactacctcctaagattttagtaagactgaataagacaatggataacaacgacacagcataatgcctgaagcatcataagcacttaaatgttggttgctattatgattggtattctttaaaaagtgctattacttgccattattgacttttgaaactggagggttcaaacaaacaagatgttgagaggctcaggcaaccagtatggttggaaataataagaaagttagttacctaccgtgatactacactaacccttgaaaaaacgtgtggcgtttaaagaaatttctgctaaatttctgtttggcttcagcaaaacctcgtgttccactttcagagcatgaaagaggcagttaaggcaagaaaagcgcatttagaagtttaaagaatgcaagtatcctatgggttgagaaatgagattaatccttccttgactagtgctctttttactggcaggataaattctttaggaaaaagagttatgctggctgtggaagtaaatagtgacaggtgttcttttgtttattttctatgtatttttcaaccccaggtccattttattctcaaatgtaacttcttttcttagtcaacctgctttttggtaaaattgttcttaaagcattcagcttacataattaaatatggttgtgtggttaccttttatatccgaatgtaaggacctccatataatctaattattttttccattaaaaaaagatatttcacagacacaagctataggtaaggattcattacaaaggaatctcattgttttaaatgagcaattccattatttttgattctgccgagagtgggacctaattctgtcaaagagagaaggttgttaagatttggtggtcagaaacacatgacttccaatcaaatttagcagtcctaactatcgaattaggtgttgtaagtttatgtgggctttcctaaggtgaattgactacagggggcatagttctatctaaggaataattagttatgttgagattcaatgttatttgcatatttgtgtctttgaaattcctctgaaaatgagtaatttttagcaattattcttggtgtttgagtccattgagctagtcaaaaatttataattgcaaaaactttggccaaattatcagatagagctaagattcggtttggggtcttaggaattcctattatctccttgaactttgggatgtatcagttattagaatttagacagtcaacgagcttgttgaaattttttttggaacaagatcagtggaatgaatggaaacaaagaagggcatatatttgtagaggaggaaaaggagtgatttgcagaagataaaaaaggaagaagataaaggagaggacggaagggggaaataaaattcacataaattgcttatcactgatattatagaagtaaactattttataacagtatctgcaatttattgttcacatagccttcaaagaaagaaagaaatgaagcagtaaatcaccttgcctcaaattataattttccttacttgtgcaatatttattgagcaattttatgcacagtgttgtgtttagtggtgaggatatgtagcaaataggacaaaacttccgtttatactggtatagtatgtttgtgcacatgtgtggtgatggtgccaagtgactgttgtagaagaatagtgaagaatgaacaaattagaaagtagagaattacaatagagaaggaaggcacatgagcctctcaggagagcttaattctattgctactttcaatggacaataatattttcaaaaggtattaataacttcaatacaaggagtctttcagcctaagtggtcaaaccaagttaagagaaaaggaaaactaaaaataaaaataaaaaataagatcaactttataagcaccgttttgatctcagatctttgtggtaaggcttgggaaacaggactttgcatatgggaagatcataaatctgggcctgtcagggatttgaagagcccataaaagtcagtactaggtgtctctgctgtgctccgaatctggaagattaatgggtaatttcgacttcctgctaattctttatacaaccaggcctatatcttttaagatccaaaagatatattaccataaaaagtttctaagaaaatgtgtaatataacctattctccttctattttcacgttctttctttttctcctgtagtcatcatcagacagttaaaaagaaatggatttttgtcaacttgaaactcaagcttgaataaccagaaataggaatcttccccattatgtttcaaaatgattttcagtgtaccctttcctaactagtcataatttagcttgagaatttcaaatattaacatattagtcattagttggtattatttcaatttttcattcttgtttaaataaattcagcttgtcagctccatatactaattactgtcaatggttttcttttctctataatttaaagtcataaagtagtaataatttagttctttatacatagtttgagcataacccatcgtgagaaggcaagatgtaatcatcactaaacatatttgtttttactaaataacagtttctaaatttgaaaaacttctctgtgggtgatatgtgaggctgacacattgagcaacaccatgagcagatgtagtagcatacgtgaaaaaattggttaagcttcttgatgtttaatgaaatttaagcacaaaaaatatattcatgtataactacttttggcttaataattcatgcatttatttgcctgtaaatactctttaaacttctgttatgtgcaagatatcatcctaactgctataaagcttataaaggtgaatcaggttcaacttctttccttaaataatttacagtccaacctacgcatgtgtataaataatctaccaccagaaaatgctaaataatctaaatggggcatttttaaagtgttgtgtgatttaaatacgtatttgtgtgtgtgagagaatatgatatatgcattcatatatttgagttgaaaatatatacacatttgtgagacagattagatataagcttaaaatgtgtatgtgtgtgcacatgtgcataggagtatatgtgtgtaagggggtaacaaggcgttcacaaatttcattaagagactaccatttgagttgactttgaagcacagataagatttggaagtatggagataaaggatatttgacaatttgacatggtggagagagtatatgaaggtatgagcagagtccagcaggctgacaaattgggacctgttgagaggacaatgataagctgtcttggctaaaagataggagattaatgagaaagaatagtggcaaataagtttcaaaagtaagtgtgtttcagatgttaagtttttattatagatattttgatcttcagtttattgaaatggagttctgagtaggagcaaaggaataccataaaggctacaaaaatgctcttagttaaaagcaggatccactagggttgggttggaactgaaataggtgtttaaattttcagtatcttcagttttgtttgtttttactgtgcttagactgttggatcacacatataagactgcaaagcgctcattaaagtgaaaatatatgcagacgtttatacccggtataacagataaattgagcatctctctacaggtgtatcccaattttttgctatgtatacccttagtggatacctgtgattgaatgtaattattatatcttctggaatgtgagcatacactgattgatgtcagacatttagactgtgctatggtttggctctgtatccccacccaaatctcatcctgaattgtaatccctgtaacccccacatgtcgagggtgaaacctggtgggaggtgattagatcatggggtttctcccatgccgttctcgtgatggtgagtaagttctcatgacatctgatggttttttaacgtttgacatttcctcctacacactctctcttctctctcacgcttctgctgccatgtaagacatgccttcttccccttctgccatgactgtaagtttcctgaggtctccccagcaataagccaggtgtaactgtgaaccaattaaacttctttccttcataaattacccagtctcaggtatttccctattgcagcatgaaaacgtactaatacagactgtggctaacaataaattgtatgtggcaggagggtttcagagtcttgtcatataaacagatatgagaagaggccgtggataatttaaaattccatagcaagcaatttttttttttaaagattcaaaaatgaattgtaagaaggggtgataaaaggaccacctcactggggactattgcttaatctttgcattggctgcacattgcctcatgcattggagacagagcattatttctgactttaaaaaaatccccacacaaagccaagtaatggggtttagtattaggcctacttctattttttttttcctcagagtttgccaaatatttgattttttcagaaaacaatcacccaagagtgcattcattgcttcctgcagaaatgtgccctttattaaaaatagtttatctgggacctgcagtgtgttgaattgtgtcctctagaaatacatgttgaagccctaacctctggtacctctgaatgtaatctttttggaaatggattttgcaatgttaaaaaatgaagttatacttaattaaaatgggccctaaatccaatgtctagttttgttataaggagggggaaatttggagacacttagatgtacatacacacagagggaagagagctgtataaagacagagggagaaactgatgcagctaccagccacgtaatatcaagtgttgccagcaaccacctgaagccagcaaagaggcatggaacagattctctctcacagtcttcagaaagagcatggccatcaacaccttcatttcagacttctaggctccagagctgtgagagaataaatgtatgtggttttaagccaccttgtctgtgctactttgttacagcacaaagaaagatggtacaggaaggaagctggtagagcacagaagaagctggtataggaagctggtacaggagccaagaaacagggaaggaaataggtgggctatatcgtgtttcctgcctgatcattatctccaataaacagatgtgtacattaagagcctttgtaacaaatatgcttaatatttacaggatgcatatattagctggaaaaaaaattacacttttttttctaaaaatattatgttctatccttgacacctgctcagagcttctgcagagagagatttgtgggaaccctgtgtcttaccaaaaatcagcaatcacacaagaggtgtagtgtcctccacaaccctagtttgtgggcttaagaccaggtgccctgattagatcttggacatataatactagaaagactcactcagtacttagtatggcttgttcaagtgttttataggaagtgcaaagggcttagaaacaatagaacttacttgattcctgactttgaaactcattagaaagtgaccttgcactgctgaggaaactctccagacgtcattggtaataggagagtttttaggaggtgaactttaatgtcccttttagctctgtgattcaatgacttaatagatgaataattttcctaaaataagttataaagaatccaaataatagaactagaatttacagtttacttggcagtaagtactggctctcaaataattttaattagttcttgttgaattatgaagtttattttatttgtattttattataaatgaactgcaactcttacttttagatgattttgctaagaataaaggaaaaggaagtaatttgaatttcaaatttttagcccatcaaatgtgaaatgaatatttaaaggtgaacaataaaattaggctgcatttttgaaaaatatttctgcttgctaaaatcagaattatacagccacgacctttaaaataaaagacagaatttcagataaatgcagtggttgtagattatagtttctggagaattctgccccaaatgatatatgctcattcatctttcctttcaaagaacaacaattaaaaaaaaatctttcagtcagttgagtgttctggaatgctaaaataatatgaatggcttccactcttccatgttaaagtgagtcccccaaaggtttacaatctttgatgtccagccatgcttgacttgacatttgaaaattctctagtaaggaatcaaggtaaatggagcataagtttctcttagcaaatttggttttgtagatgtcatactacatgcatgtaatatacatgacaattactccacagattggggcacatgtgttaatgtcacgagagcatcagtgggaaagaacctaaattttgtaatgtaatcgtagtgggatggcagaattatcacataatttatatgataaagcaaaaggaaggccgtgtccctgtaaggattcaggcaatacaagtccacacagagcatttctccatcttagacatctttgcacatcttatttcatccacattcattagctaagtaactcagggatctctgtcttttttgttgctgtttgtatgttctattctgctgccccaatctttagctgatacaacaaaagtatgagtaagaaacagggcatttataacgcactgtagactccatggcatttggacactcagtaatgtgttcttggtactttatgagaatgtgcacagtgatggggtttttgcttagccaaggttttcttcattcagcaacatcatgaaaacgtcttctccttaataaaataataacacaggaatgaagatttctgatacacaatgagcccaggggttgacaaaggaacttaatctttatgaacttgggctctccgggatcgcgccgttgcactccagcctgagcaacaagagggaaactccgtctccaaaaaaaaaaaaacaacccgggctctccaggccgcgccccgaggcctcaggtcggccggctgcccctccctctgctctgttcctagcagggctggaaaggcctctgccgctcagtggggacccagcaaagccaaaaatcaggtccgggggaagagcgaacggtgcgtgatggaggctccgagggggagcgagaggcggaggtcgcacagtgtcctgaggggggagactggaaaagcagacacgcaaccgtgggaagaaacccgaaggagtaaagaactcagagcgaaagtccaaaatctcctcggcacgcgggcctccctgcgggggcgcgggcaccgctgcgcggggagctccggagctgcagagaagcttccactctgcccgcgccgccctgagcacaggcgatgggcctcggagggagtccgcggagcgggacgcctgctgcttggacctcggcgtgagacttcgcgggacgcagacaacttgaatgcgtgtgtcagacccgcgaccactacaagacaacgtccagagacccagccccggaaatgaagaaagacacttccggttctcagagggcgccgttcttccctgagaacacggtccagggaggctggatggccaccgcgtccacggagagagcaccccaggagctccagaaagaacgtgaccacaacgcgcagaaaccaagctgtgaggccaaggtccagcctttcccgcatggcgctttggctcctggggttctgcttgcagcccacaggggccctgaagtgccagggggggaccttgggccaccaggagcgaggcaggccacgatttgagggcttaggtccagagcacctgctgctttgatgctgtttccctcgtagccgggtcctgaatgcccagagactcggcagaacatcagctggtgctactcgccttaaggcacttttgattgagttcttgtcagtttagctactgttcattagtttatgcggaaattgttcttattgaagtttgatgaatggtgttaggtttgtaaggtactgtttttcaaataaagacacatatatgtgtatacatgtacatatccatatatatggtacaggaaggaagctggtacagcacaaaggaagctggtataggaagctggtacaggagccaagaaatagggaaggaaataggtgggctatatcgtgtttcctgcgtaatcactatctccagtaaacagatgtgtatattaagagccttgtgtgtgtatatatatatatatctatatatatatacacacacatatatgtatacatatacatatatacatacacatatatgtatgaaatgagtgagctctggtttattgattatccgatgactggcagttattgaataatccatcttccccttgtctatttgaaatacttgctttctcatattttagttgtcaatgtgtcttggatatatttagacttttgaaaattattttccagtgatttattctagccctgccccaacaggacccgctgtaattttggttgttttattatacatttcaatgttatttaggacaagtccctgtcattattcttcttttgtatacatcatatacgtgtatgtacatatgtatatacatatatgtctatatatacatgtacagatatatatatatatatatatatatatatagagagagagagagagagagagagagagaaactgactgacttgggctctctagagccaccctacttggatgcaactcccagatctgccacttgctagctgtgtgaccatgagcgatttacttagtctctctgtatactgcatgccataaaaagtagaattggaatggcaagaggatcttcctctgaggactgagttaatacatataaagtatgtagaacatcacccttaacataataagcactcgataaatcatagatattattattaatgagagcttaaagatgggtaactagagagacaatctggggaaggagcgtaagtgtgcatcatctgcagacatcacagggagcaattgtataaaatgctacagttgaatcctcacagtttgaatattttaaacttgagatacccagattgagattctcattgtggttggccaatccagagcatgagaaactgaatttcaattattcatatttttgcactcaaagctagctctttcagagctgctctctggaactcaggcaaaacattacagttaaattctgaactcctttcccttcttctcactgaagagaaaattaacaagaagcatgtggataaatgtaaagcaagcagaagagtcataacccttggagagactcaagagtatagttcagtagaaagtcgtcatgtctggccaggcgtggtggctcatgcctgtcatcccaacactttgggaggccgaggcggatggatcacctgaagtcaggagtttgagaccagcctgaccaacatggtgaaaccccgtctctactaaaaatacaaaacttagccgggtgtggtggtgcgcacctgttatcccagctactcaggaggctgaggcaggagaatcacttaaaccagggaggcggaggttgcagtgagccgagattgtggcactacactccaacctgggtgacagcgagactccgtctcaaaaaaaaaaaaaaaaaaaaaagaaagaaagaaattcatctttctttttttgccacgagtagccacaggcacaatcggggatggagaggaacacagatggcatagagcatccaaaagatggcatagagcatccaaaagatggcatagagcatccaaaagatggcagagagcatccaaaaggtggcagagagcatccaaaagatggcagagagcatccaaaagatgggatagagcatccaaaagatggcatagagcatccaaaagatggcagagagcatccaaaagatggcagagagcatccaaaagatggcacagagcatccaaaagatggcatagagcatccaaaagatggcagagagcatccaaaagatggcacagagcatacaaaagatggcacagagcatacaaaagatggtatgggggttgctgaggggactctggagtcccctgaaatcgcataggtctcctataaattcatcagtaccttatattacaacatagtggtcaaggaaaaaaatgtatgctgaaaagtatatttgaatgttgccacagtaagttgctttcctggacctagccctgtgactggaccccagtaaccagagaacaccgcacccaagttaaagaagtgagatagtacaatcagtccaccattcttgagctacctgcctaacagcctggcctatgcagctttttctacatccctgcacatccttctcacctacacattatctctgccagaagggaaatcagcttgttctttgcatgcacccttttttctcttatcattttttttcttgtaatgccgcctatgactgctacaagagaaaacacgacatgaagctgctgtgtccattgcaggttccttgattttgagcaaaggtggaagggacccatggcttcttcacattcgtcaaaggagggaaaggaagctgtcattggaatgtcagacctaaatgtaaacagatttcacagaaaatctttcatacttctcatttaggggaattagtttggattgtctgaataatagatatactaatattgttattgtaaactgaaattttatagaaatataagccctacaattccagatgacccccaagagaaaaatgtgttgtccatgggaagaaaaacagatcaatgaactggaggaatggtgtgacccaaccaccttcactcatagaaattactgtgcttcattcagtacatagtatatatttacattgcaggaaaacaaggtctgggatggttagttttgctccagtagcctggaaaaagcagacttgcctatacttgcagttctggctatgatagactctgtatgtctctaagcttgaatgtaattagaaatcttaatatacagcccatcgggtcagaacctcgaaagggatggatggagacacaccaagtaccatcatttttttctgagttttatcttatatatactagttattggtacttactttatatcttcagaacttagagttttacccatcactgaacacttcatcaaaatgtaagatgttatcttactccctattcctaatgcatagctcagtgctaggtacatagtagtcatttaacactgttttaatgagtagatgaatgaatatgtggatataaaatgtgtgttctacttatataaacatctcaatgcacaggttaaaaactttcaaagtaggaaaatttaaacacatttattttccattctattttatttctaacactgatataatatggcttctataaaaaagaataccaaagggatgaaaatgtagtattatctccttttcacatagctgaacagccactcatttctttttcatatgaaaacatgaagacctagacctattagtaggagccatatcatgggtatttagcaaacgccattttcatctgaaggaggaaaatttagaatttgatctctcagctgccctcagccatgttagaattaaataagtgatcatataggcaacctctaaagtcccatgtatatgcaagactgagacagagagacatagaaccagatagggcaagaggttgaggcaccttagaggttatctagaggagttttcttaggtcttaaatatagaaacttggacccagaaggggcagacagacaacatatttactcaaaataatactgttatagctgttagactaggaatgatgacctggtctcatcgtagaaaaaggcatatgatggtaaatacatagtataatactaaatgttttatatgtcttaatcgtaactatataataacatgctcattaaaacatgactagttactttttacttttttctattttcaagcattctcttgtctaggagttagggaacattttctgtaaagggacagatagtaatttgtttaagtaattggtaatttctttactggcaaagaggccacatactttgcctttgtagcgtgagagtagccatagacactatgcaaatgtgtgagtgtggctgtgttcatgggctccaaaataaggcctggctggatttggttcaatggcctcaattggactacccatgcttcatgcttttaattaatgttcatcgattaaacaaatattatgtaccagacattgtgttatttgctgggatacaaaggtgaataaaagctaattttcatttcattatatcatgccttaaactatagtcattgccttttttttaattaaaagttattcgtgaattattagctctctaaggtaagaaaaatattactttgttggtatctttctagttgatgtaacctgaaggataagctccttcttctaacatgccttaaccaagggaagaaagaaatgcaaatgaattaggtatgctttgagtttatatgaatataactgaccttcttaatatacagggcttaatattattgcttagctctacaaaggaagaacaaaactcagtgtttctgttgaaatttgccttcaaagaaaatggagtcagtgaactacagaatccttgagatcctttgtggaatattcatgcttggcaaatccccctcgggtgtactaatattgctcaaatagagctcaagggatattgagtaaatgctgctacagaggggataagacttcagaaaagaagagtacaaacagaaacttacgtttttacaaagaactaaattgtgtgagtgctaataagaatgcaatctaagtttaatcaggagtggcttgtagaagttaggtaagtacaaatctgaaacattctgataactgtaacagagaatgttctacatgcttggacttggaaaaaaattcttatcaaatgaagttttgagttttacaaatattcaataagtatagactgattgaatgtcctttgtatctttaggtcagtgacctcttgaggcttaagagaaagaaaacatttttttttttgctaagaggtggcccagtggaaatttaacaatctagcttataaagtattggtcctgagttctccagagaaacagaattaacatatgaagagatttgttatgggaatgggctcatgtgatcgctgaggccaagaagtttcataatctgccatctacaagctgaagaaacaggaaagctggtggtgtgattcagcctgagcctgaagctctgggaacttgtgtataactggggaggctggcagtggaggatggaactggtataaatgccaaagtttaaaaatgtgagaaccaggagctgtgttatccaagagaagaagaagatgaatgtcctagcgcagaaagaaagagagatcttcctccacctttttattctcttcaggcctttaaagattggataatgcctgcctacatttgggaggaaggatttttgccttctcagtctactgattcaaatgctaacttctttccaaaaccctctgatagacacaaccagaaatattatcttaccagctatctgagcagccttagcccagtaaagttggcacataaaattaacatcacacactatgaatgaaaaacctcaaaattaaacccacactcagcaaaaatgaaaagtagcctaaggtaaaacctgatacttgtttataattttcaccaccaactgttgatatgggcagaactaatgtattttgctatggaacatggctttccttatatgtgtgaaaataagaaagttgtctttgctgaccctttctttctctgtggaatgttccctcctctattctctgataggagactttttattgcatttcaagcttcagaagttatgccctttattattttctctctctcctgtattttcatcattttttacatacatgtaatgaatcagttatgttctctcgtaaatgtcgtgttctcatgtaaatatcatgttctcttgtctatttccctgtcttctgcaagactccatccaggacgagggccatttcttaacattgcttgagtctgatcatccacttagtattacttaaagcatagtgattagctcaaaacacgtttgtttaataaacatcaaggttgcatctactttcttgttgttacaactgttccccactcatctctagtgattgctattttaaaattctgattcatgtttaatatcaaaaagcctatacattttagtgtaatacttggattcctagtatccctagcttgagataacaacagtatcaaaggctaccctaatttcagcaatgcttttaataaatgcatatgcaaaaagcatttgtgtaattttgaaaagctaataatatatgtaggtgtatgtgtgattgttcagcctacagtagtcagtgtacatgtatgtttctataataaaaacctgggaattaagctgttgcacttaatggggcctttggtactgtggatggggaagactcccttatgtcaatgaaggagttacgtctttctgtagaaattttgtctctttctttctcactacagatcatcaggttgacagtattgaattgatggcaccctaataaggaatagcaattttcatgtaaataattttataaaatactttctttttgctgcttactacttacacaagagaacaaatcagttctattacctaaaagacatactaatattatttagtaatttgtcatttgggctaccttaaattgccagcagttttggtaagtgatatcagctttctctcataaaaatggccattttttttattattacaaataacatgactcatttcagggagaaaaaatataaatttaagtcacctcctttcatcaacattaggcttttcctagtcagggaccccatttaatgtctgcaaaatttaaaattatttttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcggtgtggagattcctcagggatctagaaccagaaataccatttgacccagccatcccattactgggtatatacccaaaggactataaatcatgctgctataaagacacatgcacacgtatgtttattgtggcactattcacaatagcaaagacttggaaccaacccaaatgtcccacagtgatagacaatgatagactggattaagaaaatgtggtacatatacaccacggaatactatgcagccataaaaaaggatgagttcatgtcctttgtagggacatggatgaaattggaaatcatcattctcagtaaactatcgcaaggacaaaaaaccaaacaccgcatgttctcactcatagatggaaattgaacaatgagaacacatggacacaggaaggggaacatcacactctggggactgttgtggggtggggggagtggggagggatagcattaggagatatacctaatgctaaatgacgagttaatgggtgcagcacaccagcatgacacatgtatacatatgtaactaacctgcacattgtgcacatgcaccctaaaacttaaagtataataataataagaaaaattatttttatctaatcataaaatctacatatgccaacatacagatcataaagaacaagttgtatttatatttcaagggaaaattatgtttactctattacctatcataataatgcttgtctgttgttgtaagccatccatcatcttagaagtaaataattgttgtgctgtaggaaaacacatcaatatagagaatgatgatggtgtgattataataattatcacacatatcataggtagttactaccatttaattctgttttaacatattatagagctagtaaggtcacattaaggagaagacacaagatgaaagacccttaaagaattcttgttcactggaaattacaagaataaaagtctgaagcaaatttggttgacaagtctttttctggctaaactatagttattgatatctagttattgatattatgggtttaagaaggattaaaataactttcagttgggaagaatgttttaagtagtcatctaaaagatgagaaagttgaaaagactaaagacttaggaggctataccatctagatttgtgtaagtacgttctatgaagtttgcacgatgtctaaattgcctaaagatgcattcctcacaatgtaacactgttgttaagtgtcatgtgactctataatacctaggagatatagtttggatattcgtctcctcctaacctcatgttgaaatgtgatctccgatgttggaggtgaggccagtgagaggtgtttgagtctgcttgtttctgcctcaccagaagcagatgctggcactatgcttcatgtacaacctgcagaaccatgagccaaataaacctcttttctttataaattacccagcctcacgtattcctttatagaaacacaaaactgactaacataataggatttggtaatatcatggtgccaagcatccactgggggtcttggaacacatcccccttggataaagggggaattactatctctgtatcttatacctgacttagatggcagggctttcaggattttgccagtaaacataatatgtaagggctgctgggttgtgttacaggtattttatcagttgtgttgtgtgcgtttattcgtacagaatccattggtttctagtttcttgtttctgttatttaaaaaaaatatattaagcatctactaaaactttccaaatacttttctttcttttttcacttttttggagggaaaataatcatattttctcacattctactgttgttttaataaggtactagaattgatttgctaagactttgtttagaatatttgcatattgtaagtgggatatacttgtaatttttttcttcagtcctatattctaagttttcctcatggtgctattatgattttgtaagaaagaattgcatatatttctttcttaatttatataattgattcccaacatgggctgcatatcagaattttaaaagctagaaatgcaagaaattactaaagccagggccctaccctagatcaattacatggatgtagagtgtctgtgatttcagtttaatacagtctaagatttcttctcttttaacttttcaaaagaagtagacaaaaaagagcacttggaagaaaacagggttaatggaaataatgtcatattttctttctgcaagttatccctttttctgtctttctctttctccccccatttccttcccattctcctacaaagaagtgtttgggcaataaattaggtggcagtactctgcatgagtgaatagtttgcactgatactcagtgcttacctatttgtgtcaatactttctgagtatgttccatctgtaaaatttgaaatcacaagttccttctcagctccaggagataacagatgaaatatcaggcaagaaatgagaaggatgtgatgctgattgctttctggaagactcaatttgtaagctgctgggaatccatatctttcccagttgacctttcttgttataccttctgtacatttttttcctctaacataaaaattatcatggggattcgtaggagattgtctgattcttgaaactgcatttgttactttgtgcaatttatagcagctttccacaagtaatttatcagtgcttgttgtttagtgccctgtgacagatctaccagttcacactctcacgagagcactgagacccttcttccatatgcagattttctttcttgattacatttaattctggttctgggatattgctaacagtgatgtcaaggagcatggcatggtgtctcccccatgttctaaggccgtctcagctctaataacatctttctgttgtattaacctgctgttcagtgaattcttagccatctgcttctggcttaggactgtgatttgagtattgtatctagtggatgcaaagggtaagaagatagatgttaaacattctctttctctgtgtgctacttaatttgcttgacatattacaaattgtaagttcctgtgtctgtcaacacatcctcaccacctccagactaacttgcacaagcttcagtgtgttgttggcttaaatccttgctccctccatagttccacccagtgcctaagacgagcgaatagtttccagttcacatgctgattaataaacatcacatttgattagtcatagtaaatggttgtgttagaaagaaccccgaagccatgtatttcctactcagatctcatccaacaggaaagatttagtggctatttttattacctttttcttttttcttttctttttttattttttgtttgtttgttagtttgagatggagtcttgctctgtcacctaggctagagtgcagtagcagtggttcaatcttggctcactgcaacctctgcctcccaggttcaagcagttttcctgcctcagcctcccaagaagatgggtctacagatgcacaccacctcatctggctaatttttgtatttttagtagagatcgggtttcaccatgttggccaggctggtctcaaactcctgacctcaggtaatctgcctgtctcggcctcccaaagtgctggaattcattacctttttctaagtgttatgaaaaacactacttttcatatatataacattttcttattctatgaaatacactaatttacttataacaacattagattttttttaaatctgcactaaaactaaattcattagtgagtttattgtgtattaatactgcaacttatggatactcgaacctgaatttcttgaatctgttactttccactgtaatgtctcaggaaacaagggattttcatgaattatttatactctataagactgaaaacaaaaggtgtcttgccttagtttgaatttaaacttaaaaatcttttcattttatgtttctaataattaaagttagttatgagatatattggaaaatttggaaaacattgaaggaaactttaaatggaagaaaaaagactttacatgatcctatcctcattgttaaaatatttatatacattcttccaggtttttgttataatacatgtttttgtaatgtaattaaaattatcctaagtaaataatatatacatatatatcctatttgtttcacttatcattataacgtaagtattctctaatatttaaaaactatcacattatttttaggggctcataatattccattaaatgattttgtttacttcatctaaccattcctaatattgtttattttcattgatttcttgattttaccataattagcaatgccacaatgatatattttggattattttattttaccagaaattgaattctcaaaacgaaggaaaaagacattatttcaaggctgttactaaattaaacctctttttaaataaacaactgaatattataagatatgtctgtgcaatgtagcttttaaactttgtcattttcctaaaaacgtgagtcacggaggatggtagcaatgatgaccccatcctggcaggtaataaatttttaagtggctttgcactggaaagatggactagatgcgctattgagatctgttgtacgatatgtgctatgaagaagagaaaaatacaggaaatcttcagagggtcgttgatcccagtgaagtactgcatcagaccacatgctgtgtaaatgtgcccactgggatttcatctaaaaacggaggaactaaaaattaccaaaatagtttaacttgaaatttagaaagtttagattacagttaagactatatatgattatcagaagcttactaaaaacatatctcacttttttagtatatttttctgacaaagttcaaagttagtgtaacccttcacttcatgggtgacctgcattgtgttcataaaaagagtctttttggcagaaatcttgcagtatgccagcagttttcccaacggcctgtcttaatgttttgaaattcaaatttttcttctttgaactgtcattttatgaacctcctcatcagtttcctgatctcttcctcttgttaactggtctaactctgccaggaagacattcatgagtggctttgtatgtggttcttcagcatcacttttatgaaatcctggataatttgcagaaaagtagtttcataattcgacccacttgcacttgtgtcttaaagatctgattttttaaaaaaatgacagaatggaaagaaatagatgtcttttgtaaaaagagagaaatgtttgagtgaggattgatttgataaattgtcagtcaattagcaaatattttgtattttgagttctaactaatgttacaacctcaagattgtggctaataaacacgtgggtaaaaaggccatctatgtgctctgctccttctgctcagtcctgtcttccaaacacatgtaagtgtttacatttcacgataacaaatgaaccacataatgaagataatttcacactaaccatgaagcttagctctgcaaagaacaatggttcccagtattggcttcatattagaattgccttggaagcttttaaaaaatgtccatgcccaagccttactcagataaatcagaacttctgaaagagagtcccagataccagtattttttaatgttctttttaaaaggaaagtataaatatgtatttaccattttctgcatctcccatctttaataatttttttttttttgatggggtcttgccctgtcacccaggctggagttcagtggtgtgatctcagctcactgcaacctccacctccaggttcaagtgattctcctacctcagcctccagagtagctgggattacaagtgtgcaccaccatgcctggctaatttttgtatttttagtagagacagggtttcaccatgttggtcaggctggtctcaaactcctgacctcaggtgatccgcccacctcagcttcccaaagtgctgggattactggcatgagccaccatgcccagcccatctctaagaatgcttattaactgtatctgaagatttagtgcctgagattctgcacttataattaatccctatatgactgtaatataagttattctggggaacaatttgagacaatgctgatacatgcagataaaaagtagtagaaaaaaatggtggattaatcttattctatggactagcaattctcaattatttcatttcagtttttacttttcatttcccaatgaatatcataaatgcctattttcaactctccataggacagtggctacttctgtatattaaaaacgaaaactagcatatcaattgtatctgttttgtggtgagcattattggtagtataaggattttaattcagctaatcaaacattggcacatcggtgtgtgatactttatgtttttttccaaaatacagtgtcacaaccatacttatggaacaattgccattaaagtaatgtctagaccagtgcttctaaaacttggttgtgcattcatattatctggggagatcgctgtatgtcagattccgattcatatgactggaacaaggcttaagaaacagcatttctaacaagcacctatattttgataatgttcctaaatcttggaccacaatttgagtagaaagtctgcagcctacactatataaatatacatatatgtatatatgtgtatgtattaatatgtattctttcccgcaagactagatcgtgtaggatagattcttctctggaaattgagcccttataacttccccataattgaattcaattgaaaaatatatttaactactatttattaagggccttttatggacagagcactttaaacatcaaacacgtgatgttattttgtcatactcacttaacttatactcaaggagaagcagtaatttgcccaagtccgcatcatttgaattgacagaactaaagtttatgctcatactggtgtggccccagagtcaataatcttagctactaagcaatgttatcctccccggctcatcagcttcctaccgcctccttcagcccagtgttttcactttcttttgtttatttccgataatgatgaaagattgtttcagcttcatcacaggccatgtagtgcaaattgaagacggctgtctaggcaaggctcttaactattaacattgtggaatacgcacacaagaaaaatccacagttgtgattgtacatttagcacctccacccatactcaagttattattttatacttaaagaatttggatttcctatagggaaaatgacatagccatcatctccatttctgaatgaaaaagtagaggaaataaatgtctcattactggggggctgaaatacatctcatagcagctcctgtaaaggaaaaataactaacatttattgatctgcttttctatgctgagtgttgtgctagccacttcacacatagatcaccctactcagtcctcacaacggtccactgaattattatcttccacacgttacagatgaagaaactgacaagcagggattaaagaaagacttgcctgcagttaacagctgctaaatgatggaggcaatgtttgccttttcagcgaatcaatatagttaaaggaatatagtgtttgtttctctacacgctgcagataacaattttgaatgcattagatgaatttgtaatatattgtgctaaaatagatgtttttattttagaacaaaagaaaacatgtttaatctgatgatcactgcaataactctagcctgattgagattcatgagagtagttatttatatgaggaagataaactaacatttctcaaaaggcacacccaaccaccaatatgttttacatgtgatttataaaataaatattccacaaagtgaaagatatggagtgttttcattattcttgcattttaacatttgtaatatactataacatgataaatgaattaggttatattgattaggtttttgctgcagtcagtaatcattttactttcttatcacttatgcctgagagtagaaattaaacaaatggcttaattacaatgagaggaaatatctttttctattccaagtagtagctctgaagataaaaacagacatatttcactgatgtctaacttctaattgatgataaaaccatgagtatgtcattaagtctgtgtttgtcttgagctatttctggattaggtgagtttttcaaatatctgagtggttgtttctttttcattgctattgtttgattttccctaaatattgctttcactctaaccctatatttccataggagtttttgttctgtgggaaaagttctatggggaagttttattgttctatggaaaagtttgccactttactaatcctgccttcccttgccttaccaactaaagatgagtttaccaaagtctggactccggcacatgtgctggtcttgtctctttttattctccctctctctgcctttattttatttctgttcctatactgtgattatttatttacaaaagttctctattacatgtaagctcttgagggcaaccattatttttttttaatcttttaaattccagctataatacagggtttagcactgaataagctcagtaaacattggtggaattaatgattattaaacgcccaggcagaaaattaattgattgaatattactaacaaactttctctaatttgagctagacaatattaaaatggcaattaacttttcttctctacttatactctcaaatttatcatcatgattgtatattctctaagaaaattaactccataaaattagtcattttaagaggaattccttacattttcatttggatcagacacacggatgcgtctctttgaaggaagtcttcttttctcagcaggttgtttctgactagaatccatttgtatccaaacaatttgagaccctcgttctgctttagcgcacagactttcctaggagcagtcgccattccaatattgtccacggagctggaatgtaattttcagacaagttctgattacaccccagtggttcatgaaactctaatgcatggcagttgtttgagaggattttactagtgaacacctcaaacaagatttcaaaattttatttttgtggggtagagagtgaaatacagagaggtggtgctgagctctgttgtaatacaaaaaagcctcttggcttctaatgcagagagtacttccagaaagaatgataatttagtgtgtgtaaaatcatttctacctagtgtaatactagaataattgttttataaaagaccctgctgttattgtaatggcacaaactggtatgcattaggcccctcttgtttatattagaatatttatttagaactaaatattagaggactcttaggctagagatgcaatccaggaggtgagttgcctgtattttttgcccagttagctttctaagaaagtagaaaaaaaatctttattgtgtactaggaaaaacctgatgtggaagaataagggtctgaaatctcatacagctgccccacatgcaagttgtgtgtccttaggtaattttcataatccctttgataattagaactacaagagaaatttagataatctatcataaattacttattgaagatatttctgctggaatacatttttgagaaggatttattaaatgtcaccttagggctttctcactgattacaagaatgcttcaaactaatattatacagtcttaaaatttttaagaattgagatggcaaacttctactacagtacccttatggagcaaggactggagcttcagcatagaaaacctctagctaaataagctcaccgtattcaaatgtgttgacaaagtgcaggatataggaaaccattctgcaagtcatgacaggattctccgcaggtattttcccctaggatatttaaaataggatgtaattgatggaaatcaatttgcagaatcttatctcgaacacttctgttggcacatctgtacttttatagaatcgtctcttgaggcttatctatttcagtaaagtttctaaatactgtaacgtcagtgtctaggctaaagatatgatggagagcatctaaatttaaaataagagagagtgctaatacgcaggtattaataaaaacttttcatgttcctgctagtgatgtcccttatgggaaactcatgcaacgttatttcatgatgtttatgattttgtaatcactctaaactacagagccattttctcactttctgaatgtgtttattatcaaaacaacattatctgatcttataagactgggtcctgtatttttttaagagctttgagagtagatggcaataataggttctctcaccactctggtttcacattgttccttctgtcttagaagtgtaatttattccctagattcctactttttaagaattcagtattttgcctttcttctttaaaagctaattgtgcatctcttcactctgtacaatgttttcaattgaataaaaacgtgttaaaaggttagtacaacctgatgtttaggagacctacgaatatagtgaaataattcttcataagtgtaaagtacaaatggcctaatgaatatagtcctgaagaaaatgtagtaaattgacttttgaaaataagttcactcttttcaaggttgttttcataggctattcagacatgtattcagggaatcagccaatcaaccagattacaactgaactaaaatgatgaaacaagcatggtgtcaggacctagaaaaaccatgtgactaatacgtggtcccataatcaaaggcacttatttagaaaagagatgattttgactattacctgatagagtcctccatgtaacatgtacctattccatgttttctcatttaagattctcttttcatattgtccatattataaatgatataccattttgttctgtatttaggtcataataattagtttttaattaagctgatcttctccaaaaatatcctacccaattctgctccaactattccagttctaccccttttgcaaattccaacctaaatcttgctttttctgaagtctttttcaatgttcaatcatattagcctatcatgttgcttactttgaattgctctgacataatttgtttttaaacaccatcatgccatacagtgcatagtccattacagtctaatttatggatacgttttgctttaccagtgattctcctgattcacttagattcttctactaccaagagtctggaaaggaaatccgcaactctcaagccagttttcaattccctttgctttatcttgtgaacatgataaagtttcctccttctctgattcttgatattttctactcttaaaatagcatttatcatctatttcatagggaccagatagagccataagtttacatgaggaaaaaaaagaattgactttgtgttagcttcccagttcagagattctcattacaactgtattcctgattgccaaaaggccctttaaatgaaatgcctcctgtaacaaagggaggctctatgtgggctgactttattatccaacagcagggaatatctgtgcattgaaaaaaagaagaaaatgctttgaaagaatacattttacaaagccggtagtaggtcaggggagcctttgcctgactctacgttagagtttttaaattgcttttggatgaggacagcctatttttatttctttgtcatccaacattgttatgataaataattaatttgctatattttatgtttctatcataatccatgttgtgagatcactgtggcattttgctgtaatgataagaagaaataaatggtgctacaatgcttaggaaagattgtgtaatttccagtgatggacagtctgggaaacttagcaaatggctggcctgggtctcacctagtagaaaaagctcagaagagatgagttaaagcgttgtcaattgttcagtcccatcccttcaatggaagtgctgaaaattaaggcacaagtcctaagccctgctgtaagattgtacaattcacaacatttcctagacccggcaacatgactcacagattggtgctgtctctgtctctgtctctctcaccacttgctctctctccccatcctctctctgaaggggaagactccttcagaactgtttttctgtgtagcatggatggaactggagatcattatgaatttgaaattagccaaatccattcttaaatacctcagactgacatacatcttccaaggattcaagttccagctggcatttgaaaacatggctttagaggctcattcaaccctgagattctgtgattgcatgatattctagtttaccttcatcttttccattttttcttttaaatgtaataatgcttccagtgtatattagtcactgacaactaatgaactgtaaaacattttcttatgctttccatagacccatagctagagatgttgacccagtgattaattctaaattgcaatcgatgggtaattattattattattattattattattaggcttttgaataatattgaatatgtccctgaagttagaaatttttccccactttcaaagtgaaagcctggaaaaatagttaagttggttcaaaagagccaaggattttattctttcttatgatactatcctcccaggtaagattttatatctatctatctatctatctgtctgtctatctatctatctatctatctatctatctatctatctatctagatatagaatcacatatagatatagatttaatatctccaattacttgcagaaattcatggagtgctgacgtgctgagagtatgtaaatagtacaccctaccgctgtttaaccttgtggtgaaatcatgtgcactcttcaggtcatgttccagtactttaatcaagttttccatttggtaaactgaaagaccctgtatttctaatgctttgctaatcactataggagcaaacatttattgaatgtgtcttatggaccagacactggtgatgataagaacaattgtatttattctgtttccttgaatcgtcttggccataccttatcgaggtacaatatttgctttcattttgcagatgaggaaacgtagattatgaaatgttaatcaactgactcaatgtatggtaaattctttctatcttactttctcccatttagtttttttctttcatttattgaacaaatatttatttagtttccattatgtaccagatgctgtgctaaacatgaggaatataaggatgaataaaacagaagtggtcttgtcaaaaagtaagtgacggaaatggaattctcacccaggcccactttattccaaggataaactcttcaccacccagtgtgccttcctcccttccttccagccttcctcccttccttccaacctcctttccttcccttcccttccctttccttccctctcccttccctctcccttccttccttccttcctccctctctctctccctccctccctccctctctctctctttttctttttttctttctttcttgcttgcttgctttctctgtgtgattcttcctatatcacaacaaagaatgcaatcatgacagtgaatatgagagaaggttttcttcgtatctgattgactaactcccttctactacttgaggacagtgcagctcagcccttctcccctcccgtcttggattttctttcccctgccatcctagctgcagaaagctcagggacatcagcccattcaaatggtgatatcccatctttcaagatttaaccccctgtatcttgcaaaccatctcactttccaaagccccttattaaattgtccaaactcgctgtttaagtaagacatggccatttccacatgacagaatataaactgctgatagtttttgtattgtattatggggtaaagggacaaatctactgtgaccagtgataatacactcaaagattctcactgcctcaggcactttctgaccaccctgctcagggacaatccatgtctccatacccagtaagtcatgcacagcattccagatagggaagattctttgtgttaattccagtgatggctggctgtagtgggttttatttttcaggtaaccctgagccaggccctgtgggaactgaaatacaagtagaccttcctgtgagttccatacagagatctctcaggaacttgctcttttacctcccggccactctatgataagtggaagttaaaggagttggtttcactctaccactacttcactgtggtgctcagtgtgacatgttcacctggtgttcagaggtctaaaagaaatgaattctgcagtacagagagaaattttaaaagggagagacaaaaggggaaaaaacaggatgaggttagcatatgaaagtgttttctttccctccctttgggctggttttacaatgctagtgtgctagtagaatggctgctttcttcagcactttgttaaaggtccctggttgggtaagaaacttgactgcactaggacacatcaaacaaccagccaggctttggtcttacccaggcactgaaaagctgagccctgtgctctgctctcccatttgccacattttgccggatgagtctggtatgcttcagacaagcagttacacatttcacgaaggaaagaggtcggtggatggaaaattactgtcatttttagtgggtgaaggcaaagaagacctaccttctcttccattgtgagatactgtacagcaccttcgattcatgtgcgtaggtctgaattctgttttcaggatacttagtgttgtgtttgtagaattgaggagatgctacctaggggagaccatggagatccactgaagtggctgcggctgattgtgattgaatttttaagcatttactgaacattcctaatttgtctgtatggaggttaacaacaatttcctacaaactgagtcaaaaggacatattttatttttgtttgtacatgaactttctgcatcgtctgatgaagaccattatcccctctttccagatatcctcattttctttcttctaaatgtctggttgccctttctgagaatttttcattgattcctctttctcttcctagctgtgaaatattataccaggttcctttctcaccctgctcaccaactcactccttccaacttgtgtgttaatttcctcactcccgtaactcatgagaaaaacaacaacaaacaacaagatttgaatgtgttaagctgtaccccatgctgggatagttattttgccactgactcttaggaatcactgcctgatccctgctactctaaattcctgtctcagtttttgtcaataattaaataattaacttttggttatagaaaaacatagacctaagacctatgtttaccccaaaagggaactaacggcgtccatttctctctctgaagcctgagacaattttccggaactccagaattagctatgtgcttgctagtgtttcccatttgatatcctataatcaaatgtgcaaaattgaactcatcttttcttcaccctaaactcgcaattctgcttatatttccatgtttagcaaatgtcactattagctatacacatgctctaattaaaatatggaagtctttcctgatttgtttcttttcctaatacattttctacccagtgattgtgctcctggtaattagtttattgactttggctctgtcctctccatcacttgccaccttattaagaccccattattccttgtccgtgtgatcacagaagtttcctatccggtcttcttgcttacactgttggattcttctaatgcattattcccacagcagctgccagacttgcttttctaaggcataaatatagcctatttatcccttgattttgttctttaatattgttctcataagcaattattacagctggctctaccagtacactgtattttcttccctgagtgctacttccagtttccagtataggacatgagcatgctcttctgacctggaacacatgcaggctgcttgctttctctacctcactaactgctaatcatcttcagaaggcaaggtgatgcaaggaaaagagaatgcactctgattatagcctcagactgaatttccaatcccagttctaaaacttctgagctaagtgactgaaaaattacctaaccttgtttagtatcaatttttgtatctgtttttcagataataataataatagtagctactttaaaaggttagtggattgaggtacatatgtaaagttatctattggtttgacttcttcaagcagccacaactaagttccagcaaaccaaaacaaacaatttattaacaaaactctatgatacttcacaaaattaaagaaaagaatggcaaaaccagaatatatctatagatgtaaagagctaaaactgaggacatcataaccctaggaatcctagggtttttatctctgcttctaagttgcttttaattcttcatctccatggctccaagagataccatatacctagttagccccatcagaaaaactaggggcaatgactctgaatggccgagcttaagttatgtggctaacattagactcatccctatgacagataggataaggagcattaattatctcattttggatcacatgtctatctgtgtggtagaagacctgagccaggaaaaaacgcaataattgtagtcaagagcttctttgtccaatgtacaatacattcttcccatacaaaaaattacaagagtcgttctatttaacataattcaagtatcacacatgcattcatcctcttccaagtagtagaaaacttaaagtcatatccaactattgcaaccagaaccaagtttatagtatctctgggatgtgcattccttttaattatttgctcatatgttgctcattaccttgcaatatatgaacaaaatctatatgtttaaccacatctcagacatgcattatacaacaatgttgagaaaaacaagaaaacagctataaaaattcccacgtaggatagggttacagtggaatccccatatatctgttactggttgaagaaaataatatatgcatggacaagaatagtaaggagcagacattggttggcttgaacctttccagttgagtcaccattgcttattttccccatctgacctttatggtacttcttctgagcattattctttctggctgcacctgagggggtctttaggaaagactccctggggactgtacatttttctgtgcttctctagtgtagtcacaaggtgctaacagttactttagaagttagcagatgtatcttagaaacatgttggatttacttgggaattcaattacataaaagtcaaattggccacctaatttggatgtttttatgtgggtagatctggtttgtttaaaaatcaaacaaccagaattattattcagttgtaaactttaaatctgaaccctgaccttgcaaattctaaccttaataaggctcttcatgttttgcccatttcactaggacttattttaaagctttcaaccacagaatcctagattggatactaagaaaggatgaacagctgttctgaagctgggaatccctgagaactgggcatttcagttgaaggagttataatctctttctgataagtcacatcccaagaaaagataatgagagcctggagcaaggcttccaccatttctgtggctgctgtcatgtgctagactctggtcgttttcacggcatagactcgagttcaggtactaggccattcctacaacctcacctggtgacacacagagtcccgtctcttcagaatgccctttcctttcttgtctgttattcatctgtcatgaattcttcttccaggtagaacattagtttttctgtaatgaaaacatttcttctaattctatctaaaacaaaacatttctccacttatagatgataaatttagcactttgtcactcaatatcttgtgccactctttgttcctatgtgtgagtcatgctacatcaaagaaattcaaagggaagaacatgttacacaattctattttctatagcacccagttcaaggttgaatatttattaattcactttgatctagcatataaaaactaaaaaatgattagtcacgtggagaagagggtggggctagcctgtggaaagtcacagagatacaatatactcataacaaacctgcacttgtatctcctgaatctaaaatataaaaaacatttgaaaaaatctataatgcaattctgtaaaagtagagtaataattctcttctattttttctacctagatgtacctgagtacatctcccttttgctgccttgtacagtgactcaggcagtggtgattaatccaagaggggtggtggaagaggctgtgcattcatgtagaaatgcaacaaaaccaccaagcctgtgtttggctagaaaagcttcttaggatgttctgatgcttggtcctaggagacagcacttttcccttctatactaagctaaatggctggattagcatggaaaactgaaagttagaactacaaagtacctcccttgcattctggaaatgcggaagaaagcaagctgtaatcttggcatgtgaggaatccacagtctaagtgactgacaagtgcgcatgtgaggacaaaccatgatagagatgggcacagagtgttatggactagaatagaggagttaggtaagatttcccagaggaagtcatgtgtgggatgagtttaatcaaggatgctacatgaatcattaccatcgtcaacaaaggagaagttaggaggacatatttttcattgatatttttacatggttaacagtgattggatgtgggaagtgtgtgtatgtgtgtatgtgtgtgtgtctgtgtctgtctgtgtctgcatgtatcccgagatgtcattaacattccaggttaatactcattcatgtatttattgctcagtccagcttcccctccgtggtttgtttttttttaatttctagtttttttttcttcaactgttattttaagttcagcggtacatgtgcaggatgtgcaggtttgttacataggtaaacatgtgccatggtgtcttgctgcacaaatcatcccatcacctaggtattaagcctgttagctcttcttcctaatgctctccctctcccatgccccttaccaccctgcgacagaccccagagtgtgttattcccccccaacattccatgtgttcctgtcactcagctcccacttataagtgagagcatgtggcgtttggtttcctgttcctgcattagtttgctgagaataatggcttctagctccatccatgtccctgcaaaggacatgatctcattcatttttgtggctgtacagcatttccatggtgtatatgtaccacatattccttattcaatctatcattgatgggcatttaggttgattccctgtctttgatattgtgaatagtgctgcaatgaacatatgtgtacatacatcttcatatagtataatttatattcctttgtgtacatactcagtaataggattgctgggtcaaatagtatttctgcctctaggtctttgaggaattgctccactgtcttccacaatgattgaactaatttacactcccaccaacagtgtgaaagcattcctttttgtctgcaacctcactagcatttgttgtttttttggctttttaataataaccattctgactagcatggtacctcattgaggttttgatttgcgtttctctaatgatcagtgatgctgagctttttttttcatatgttggttggccgcgtgtatgtcttcttttgagaagtgtctgttcatgtcctttgcccactttttttaatggggttgtttgtttatttcttgtaaatttgtgtaagtaccttgtagactctggatattagtcctttgttagatggatagattgcaaaattttctcccattctttaggttgtctgttcactctgatgacagtttcttttgctgtgaagatgctctttagtttaattagatcccatttgtcaatttttgtttttgttgcaattgcttttgttgatatcattataaaatctttgcccatgcctatatactgaatggtattgcctagactttcttctagggtttttatagttttgagttttacatttaagtcttttgtatgtcttgagttaatttttgtattctgtgtaaggaactggtttagtttcagttttctgcatatcgctagccagcactcccagcaccattgattaaatggggagtcctttccccattgcttatttttattaattttgtcaaatatcagatgggtgtaggtgtgcagtcttatttctgagttcttcattctgttccattgttctgtgtgtctgttcttgtacccgtaccatgctgttttggttacagtagccttgtaataatatagtttgaagccaggtagcatgatgcctccagctttgttcttttgcttaggattgtcttggctatttgggatctttttggttccatgtgaatatacaaatattttttctaattctgtgaagaatgtaaatggtagtttaatgggaaaagcattaaatctataaattactttgggtagtatgtccattttcacagtattgattcttcctatctacgagcatggaatgtttctccatttatttgtgtcctgtctgatttccttgagcagtggtttgtagttctccttgaagagttccttcatttccttgttagctgtattctttttgtagcagttttgaatgggagttcattcatgatttggctctctgcttgcctgttgtcagtgcataggaatgctagcaatttttgcacatagattttgtatcctgagactttgctgaagttgcttatcagtttaagaaacttttgggctgagatgaggaggtattctaaatataggatcatgtcatctttaaataaagataatctgacttcctctcttcctatctgaatactgtttattcctttctcttgcctaattgccctggccagaaccaataccatgttgaataagagtggtgagaaagggcatccttgccttgtactggtttttcaggagaatgctttcagcttttgcccattaagtgtgatattagctgtgggtttgttatatatggcttttattattttgatgtatgttccttcaatacctagtttactgagagttttaaacataaagggatgttgaattttattgaaggctttttctgtgtctgttgaggtaatcatgtggtttttgtctatagttctgttgatgtgaggaatcacagttattgatttgtgtacatttaactaaccttgtatcctggggatgaagccaacttgatcatggtggaaaagctttttgatgtgctgctggatttggtttgccagtattttattgaggatttttgcatcagcgttcatcaagtatattggcctgaagttttcatttttggttgtgtctctgccaggtttttgtatccggatgatgctgacctcatagaatgagttaggaagaagtcattcaattttttgagaatcattttcaattttttggaatagtttcagtagaagtggtggcagctcttctttgtacctctggtagaattcacctgtgaatctgtctagtcctgggctttttttggttggtagactatttattactgtctcaatttcaaactcattattattgatctattcagggattcagtttctttgtggttcagttttgggaggatatatgtgtccaggaatttgtctacctattctagattttctattttatgtgcgtagagatgtttatagtattctctgatggttgtctgtatttctgtggggtcagtggtgatatcatttcttatcatttctgattgtgtttatttgattcttctctcttttcttctttattagtatagctagtggtctatctattttgttaattgtctccaaaaaccagctcctggattcgtttattttttgaagggttttttgtgtttctatctccttcagttctgctttgatcttggttatttcttgtcttttccagctgtggggtttgtttgctcttgcttctctagttcttttagtcgagatgttaggttgttaacttgagatctttctagctttttgatgtgggcatttagtgctattaagttccctcttaacactgctttagctgcatcccagagattctggtacattgtttctttgttctcattagtttcaaagatcttgttgatgtctgcctaaatttcattgtttacccaagagtcattcaggagcaggttgttcaatttccatttgatggtgtggctttgagtgaatttcttgatcttgagttctaatttggttgtgctgctgtctaagagactgtttgttatgattttagttcttttgcatttgctgaggagtgttttacttctgattatgtgatcaattttaaagtgccatgtggtgatgaaaagaatgtatactctgttgtttgggggtggagagctctgtaggtatatatcaggtctgcttgatccagagctgagttcaggtcctgaatatctttgttagttttctgtctcaatgatctgtctaatattgtcagtgaggtattaaagtcttccactattattgtgtgggagtctaagtctctttttaggtctctaagcacttgctttatgaatctgggtgctcctgtattgggtgcatatatattttagtatagttagctgttcttgcttaattgaaccctttacaattatgtaatgcccttctttgtcttttgtgatctttttggtttaaagtctgttttgtcagaaactaggattgcaaccccttcttctctgatttctatttgcttggtaaattttcctccatccctttattttaagtctatgtgtgtctttgcacgtgagatgggtcttttgaagacagcatagtgatgggtcttggccatttatccagcttgcctttctgtgtcttttaattggggcattaagcccatttacatttaagattagtattgttatgggtgaatttgatcctatcatcatgatgctggctggtcattttgcagaattgtgtatgtggttgcttcatagtgtcactggtctgtgtatttcagtgtggttttttagtggctggtaacaattttttctttcaattttcagtgattctttcaggagctcttacaaggcagtcctgagggtgacaaattccctcaggatttgcttgtctgtaaaggatcttatttctctttcacttatgaagcttagtttcaccagatatgaagttctaggctggaaattattttcttcaagaacgttgaatattggcccccaatctcttctggcttatagggtttccactgagaagtccactgttagtctgatggcttttcctttgtaggtgatctggactttctctctggctgcccttaacattttttctttcatttcgattttggagaatctgaggattatgtgtcctggggttgatcttctcatggagtatcctactggagttctctgaatttcctgaatttaaatgttggcctgtcttgctaggtttgggaagttctcctggatgatatcctgaaatatgttttccaactttattccattctccccatctctttgaggtaccccaatcagtcgtaggttctgtctctttacataatcccatatttcttggaggtttcgtttgctcttttttattcttttatctctattcttttctgcctgtcttatttcagaaagatagtcttcaagctctgagattctttcccctacttgtctccatttttctcaggaggtattttaacaaaatttaaagggatgtaccacactgtttacaattactgtgtatatttgtgtttacgtgtgcacgtgtgtgtacgatgaacccaaggaaagcatattctaaaataaggaccaataatattattttctatgatttcttcttagtactgaacccaataaaggaatatcaagaatgtttcagacagtagggtaagatagagataaatcctacaattgccacttataatctgggtaactttgggaaaattacctttctttgaacttattttattaatttttagaatgagaataataaaaataccctcctcataggactgtggtgaagattaagagaattaattaatataaaacagcatggagccaagcatatggtaagaccttaaggaattttatttcattaattataaaagacacatttctcccctacattttaacatctccgtagagaaaatatgtcttacaatttatgttcttatagttgatgaagcaagtattcttatttaaatatgatttataatcgaaacatagttttttgttttaaaatgttagaaatcaacactatgaactcagataccaattctctcagtggggatagtttgcagtgaaggaaataaaatggagaaatttgcaaattaggacaaaattaatatgtgttctctttgagtttattcatatttattccacaaacatttgaatggataaccatgtgccaaattctgtgtaggacaaatttcacaagatgaataaaacgtaatatttgtcttcaaagatctaacacatgttcatggaagacaacagaaccgtataagtacagcatcagttataagtacctaagctaattgtttacatagaagaaagacctaattcataggagaggagagggtggggaaagacaaaatgaaagatgtgatttctaaattaagtctcaacagactggtaaagtgagccaggtaaaaggtgaagggaagtaagctctagaaggaggtaatacaaaaggacttgggagaagaagagagaagaatctttcttgtccaagaaactacatgatatttaatttggatgaaatatttgcagaaggagtaaaaaatctcagctagaagttaagaagggtcagctcacggaggaccttgcctagttatgctgatgagcttgaactttagcaggagttaaatgaaaatactctgaaacagtttaaaatggagggggtgatatactcacaattttatttccaaactgttgttcagagtgaattaaagtggataggatcaaagacaaagagggcagttaggcgcttattgtgatcattattaatagtggtattggagatgtagtgaaatgggcgattatgaaagtgatagaatctataggacttgatgattaatggaatgtgaaatagagagaagttaagttgtaataaccacatctcagttcaaatgataaacaaatgccatgcagatctagagcgggggccatttgcctgagccattgtgcctaacacagtgctgagtccacaataaaccaatgctaaacagttgtacattgacatatcatcgattcctctggaaattctttgagtacttcacacacagatgtccatattgaattaatacataattatcaagagaaaaaatatccctgagtcaacattctagaaatgttcaagtgtctagattggattttctcattgtccttttccataacaacacagtgacttggaacataacatgacactaagaaatagaagaataaaaaggatcttgaagcaattcccttttatcttgctttattcttaacagcatttctctggtctaattcttttatggttccagggagaattacatttcaaattccataattgcacaggagaattggagtcttgtaaaaatttagagtacttcattcaaaggcaatttttattatcaactgaacctatgctgtgatgcagccaaagaaattgtttagagcatcattaaaataacctttttaatatgactgctttctcttgaaaaaatgtagcaccctcttatttaatattaccatattacaatggactatatatttgttgaaagtcttatagtatggtatttagtatattgaaccagcacaaaatatacatgaactttatcagttttcattttccctttacaaaccaagaacaatattaaatgacattttatgacatttgataggtatttaaaatttgttattgaggttcttcagtgagccataaaatacaagtgtaacagtatggctgtgctttcattatgagaaatgcaagcaggaagcatttaaatcagcaccattttccatcaatgtcttgctcctgattctctgccaagttcattatctcttctgtccctaaatttgtccatatgaaaaattaggagaaaaaagaataaattaatacctgcctctaaaatgatctgaaatccaggtatggaaaatcttatacaagtttaaaagactggtttattcactactgtcctcatttgtttgaacacactacaatgttctgtgggatagtagctgagagacaagcaatagtccttttcacaccttccatccgtaaagacaattcttttatttgcagctgaagctattatatccagagcctatggctgtttggctcttttaacaatggaaattttaaaagagaaacagcaggtaaaatgtgaaaatgtcctctgggatattattttattactacatgtcccttatcatttagcaaactagatgcaatataaaaaattaagtcagtttgtttggtgcctggttggcaaaaaatcaaataacagttactaaagaaataatggtgagctaacctaaactctgcgtgtgtgtgtgcgcgcgtgccataaagccaaggtggagaggtgaatgaaaaagtcattagaggagaggcaaaagccatatcgcttgaaaaaagcaccatggtatcatggtcgaagaatgggctttagacgctggcaagcttgggtttcaattatggcattttgcagtgtgctatttatttccgagcattaatttctacaatgaaaaaatacataattaatatctcataggatttgaaggatcaagtgagatgactgaaataaagtatgaatccagatgtctgtcatattaattctctcttttaatcatgggagctattgacaatgcaaaaggtactcagtatagcactagaatgatagtgtacctcccgagataatgtgtaaggtccttcactaacacctttttcataggaatattgttgagctgccttcacacagatagaatatctgggttacaaccactttgcagaaaagttaccagatatagctttttgaaattttctgcctgggttaaaattacagtcttgtagtaactctttggtgcatattagtaactgctgaactgtgtggtgttgagccaatcacattgatgggaaaggaaatttaatgcatcagacaagggaaagttaccacggttagttagtagacatagaatgctctaagttagtaaattcatggtaagttatgcaatagaagagatcataaataactaaataacagggaaactgcaaaaagactagcagaagttggctgggcacagtggctcatgtctgtaatcccagcactttgggaggccgaggagggtggatcatgaggtcagcaattcaagaacagcctgtccaacatgatgaaaccccgtctctaccaaaaatataataaattagccaggcatggtggcaggcacttgtaatcccagctacttgagaggctaaggcaggagaattgcttgaacccaggaggcagaggttgcagtgagctgagatcgcgcaactgcactccagcctaggcaacagagtgagactctgtctcaaaaaaaaaaaaaaaaaaagactagcagaagcacatcagttattattattctgtaggaggttcaaccagaatctatctctttgctctctattatctataagtcaccttctagatcttacaacaggggcagaagtacacctctctgaaatatccttcttacaactgtaacttatagatttggtttggtgtctacattgccaacattacttaaatgtttacaattccactgtgacctgttgtcactattacatttcagagatgtataaaagaaatgtcctcttctatgcaggaatatttgtatttcatgttggaattaaaacccaggcatgttttagtgtacagataggtacccttctaaaatattaaatcattaccccacagcatgaattaacctttgtgcctctgctcttataacatcattaacataatcatgataggatataaaacactcatagttaccctcacccctgctcttggctctctctgagggaagccagcttccatatcataaaaagaggcccataaggaaaaaaaatggaggcctcttgcctggagctaggagaattagctgtctgggaagtggatgtttcagtgtcagtaaagccttcagctgactgctgccccatctgccatcttgactgcaacctcatgagagaccacgagccagaacaatcccagccaagactccccagggtgcctcacctcagaaattgtgtgagataaatttgtcatttttagctattaacttttaacattatctgttatgcagcaataaataatcaatacaggagggtcaaggggtcaagtgtttcttgttgatacccagaacacgtgagatcagggagtaagtaacagaccttctagaacaagggttgattaaatctaagtcaggagaacaaggctcaatcagtcaagggatcttggaaagcaagtgaaagtttggagagttgagaacaaggcccttagaagtgactcatggtgtgaataaattccagagagcaagagcaactgcctgcctggcttcttgcattttcacagcttgcatttggaaaggggggcttggtgcattcaaatgaataaaaacaagatggtcataacatattatgaatactgtctgtatagtcaggcacctttcccaaagtaataatttgaaataaagattccattggtcagtaacaggcaattcccatttttgagtgctttcgtgatgtgttcaatattcccagttattacttcccaggcattatgctttatagaaaagtacctattttttaatgactggataagctgggccttacaatccacttcaaacctgttgttctatttgtccatgagtacacaggctgctctaggcaggaggacatgaaactacaaaccattaaatggtgataatctaaaaaacgttaagtaattgtcttgcagacgtaaactcagaataacatgctatatacatcttggaggtaccatgaaggcatggcccaagctgtatatatgtatgcgtttgtataaatatacatatgcatgcaatcatatatacatatgcgtgtgtgtgtgtgtgtgttgagagaaagagaaaggagagatacctagcacaagaacatattttgataatttaattcacagacataaaaaggaaatgtgggcacttaagagactttcacttgaacgatatcgctccacagtgaggcctttggggaaatctctgcacacactgcaaacactgttatggtagaaggaagctttcttctccctgttactattagagagtttgtcacctatctttgaggctcttggcccatatctaagtatgaggaaagaaaccttagcagtctttgataggcagaggataacattgtaaaccctagagctgtgttttaagaggaagttagaacaccagtaagaggaaggtttacatgttaagacaaacagatgaaccagctgagtaaatgtgggacttgaaggtttcccaatactctccagctccaagaagaatggacttaattaactgagagctgagaccacacagtgtgggaagagcagaggaaccagaaggggcaaggtcaagggagtgaatggaaaggagagatgctgctggactctgttgaacaaatgggagagtatgtgtctatttttgtaatctattagttacgatactcttagatacaacaaggaaagtcaaattcgggtttgttgaaagacataggaactttactggctaccgtgaaaggagagccccgtggtagatggacattaaggctgtactgattctgtggctcaaaagtatcactaagagccatattcattttcgtgtctttgtcctgctcctgcctgctatggaaccagcttaatcctaaagcctggatccccatcagagtcacagaatacaaagcatttgtatgttgtatggaggaggagtaactgttcaaataaaaactggggaagtctccaggcaggggggaaagcaactgtttttgttggagaatcaatcacctccccacaccaccctccaccttctcctgcccctgtcccaatggctgtatcatcctatggagataccatctgcatatccaatagacagagtaaaacaaacaaactcctaggtgtagattacttcccacctttccaggtattaaaggtattttatagaaatatgtgtgtatgtatattttcctgaaagagagtaaaaatatttgtcaggaattgaaagaaatcggtgatcctaaaatgtcaaaaatcacaaaattttaggtaaagtttcaagataaattggttcttacttctcttctattgtttccccaatttacatccacatcacaaacacaagaacaactcaaaccttttccttttgtcatcctacaccatgtcatgcctcgggttatttgaccacgtcacttcctctgcctcttctgcctggtaagccttaactctgcctttatgacggaattcatgtacagcctcttcactggagcttttctttattgctttctctttgtgaacagcagatccagctcttttgtaccataaacgtcccctaacaataagcacatactccacaacattggtactttttgtttgcctgtcctactccctaatgagactgtgaggaatttacacacaggatttgtgcctttcctattcgtcttttggtgagctgtgctggcttatgaagctgttgttcagtgaacacacaaccattgataggtgtgattttcagcaaagtgacaatagagaacgtgtaggagctttgtgatggtgtactagtatcattgttattattattattattcaatttaagagaggtttttctccttggttaggacctgaaaacctacagggcaatatgataaaaataaatctctagataaatgatgtgatcttctttaatcttggggattcacacatcatggccctgaagcaagctagtgaatgtaattcttaagtgctaacatttgtggagtgctttctatatgccaggtgccatgcttaatgctccacattcatcattccatttgatctttacaaaaatctcaggagatgggttccattattattggtcccattttatagatgagaatgctaggatttgcagagagtatgtacatcatccatgtcacactatctgttcattagatgaggcaggatttgaattcagggccctctagctataattaagcccttcagaccagttaaagattatgctttaaggtgctctgtgtgcaaggcaaagcgctatataatttattataaaatattctttaactcttaaccataatcttgcaaggtagaaattattgctctcattttaaaggtggggaaactgagttttaaagaagataactacatttgcctaaaaagtataatcagtaatgttagtgccaccctttgacagaagtttatttaattcctgaattcatgtacctttcaatcgaaacccaggaaaaacgagtgccaactacatccaaggaattgttgatgggaatggggggtgggcagtccaggaaagctgaggctgttatgagaaaatgtctctgccttgtggggacttataacactgtcaagatggtaaaatctggtattataaaacaggaatagcatttgaggtcatctatgaaaataatgtgaaaagctagctacaaatgaaaaatttaaataacaaatcagcgcaagcctagagagatacctctggatagaaggtgattaattctctagtaaattagatgaataattattgatatagccactagaggaagggggatttgggctccaaatttactcactgtctttgaagaagctggtcctctgagcatctgtaagttacctcactgcagtgtaatgtgattgtcaatgtatttatagatcaaccacattagactgtaagttacatgagggaaggtggggccatgtattgtatttttgttctcagaatttgacctaatttgttgtacttagtaggtattcagtacaaatatattgcatgagtctaccatcacttcaaccaggggggcatggtcagaagaaccatcatacaggaagcaagttttgaagtgaggaaattttttttttttgacagtttaagatggtatgggaagtccctttaggtggatgaaatggtgtgagccacttgatgttgttgggagagcatcacagtgggcgatctctattcctagcatctgcctggtccactggtagtgggtggccattgctctctggaaatggacctgcagagagggcacaggcaccaggagatatcagagtggcattatataatttaagatatttagccttgatcttgaaagatcacatgctgccctgttacctcgtatacttggctccttctccctggtccatgaggccatttgaagacacttaaaatgcctatttcattcctcactgcacctatggctttatattgccttgtcatattcaacgctgatgctgtggtctgcacacgtataagtcacaaggatgccttctggcatttatcaggcacaggtttcttggatccatcctggattctgcctctttcctaagaacagagtatggctctgaaatggatgctaacctcagaccaaccagctgagtggatggaaaggagccaaaggaaaaccccagaagatagtccagaaagaagatggaggctcttatgtctgtgttgttcacatcaaaatcttcactttctttgtaccttgaacaatttggagtccactttatcttgaacctacatccaaatacctctgtattagggtgagcagggtgggaagaaggggaggggatatacattggcagagagatgatcttctcctggaggttgtagtgtgtcaccaagaaagtcattgcattgccggtgagattcaaataattaaagtatatgtgaaatcactttcaaaaaattctatatggaaagttatatgttgtaattaaatggttttattgacatagagttttacattaacgaagcattctttttcaaaaaaaataatatatctaaatctttttctcagttaagaactatgcttcttgttctggggaaaacaaaccacttttatttacaggagaaacaaatatactttttaaaaatccagaaaattgtaaataggctagcagagctgctaaacacgcataagatcacaattgtgattttacaatacatcttaataaaaagagtaaattacttttcattttcacagacataagtttgtttttaggctttcccaagtggattgatacacttgtttgaatgtgatttccatttacctttatattaaaataaatggaagtgaaaaggtcaagtttattcagaaaattgttagctatccttgggaaaaactaattcagcatgtgtgattttaatcaattttcattcattgttaaagttcacacaaagtttagcttgatgtccataggaaatggaagtggtgactggtatatcaggcacgataagtataccaaatctgaagtcctctagatagtatggttaataaagcatatttgtctggttccataaaatagaaatgttgaaactagaagagctgctgggttaataggagcattttcaattctcaatcttcattattctcaatgccaagagggaaaatttgactcaaacacactgtttgggctgtaaatcagagtagttacagggtgacttgggaccagctatgaaagaaagaacccagaagtgggtgatatgaggaaatatatgccccaaagaagggatttgggcctttttcctactgcctcccacagagccgggctgtaccacatgcttttccaaattttcatttagctccctttatgtgctagggatcatcagggcaacagggcaaggctggatgatgttatggtgttataaaggttaggaataaggcaatgctcagaatgatgtatttcagaaaggactacatgcccataaatgcaatctagataaagatgggattaggcactgaagctgtaattgtgctggtgatagacatgccagcaatagcagtggtgttggtgatagacaatcaaagatggaaaggatccgtgtggcctgaaataagatagattggggagaaggaaggtcttagtctgatagtgaagtaaggagagggattgaacaggctgattgaatgatcattccaggcctcagtagggatgcagagatagggacgctatgtgatagatgtgtgtagatactagcctattctgctacagccagtaggaatgttatgttttgacatatttgattgacagatgcaagttgtaccagactacacaaaccaaatagttaatagttatctcaaaagaggatgttgacagatttcaaccatttgcagggtcattatggcccaacctttggaaaattaccattggtatccctcaataatattattttgcaatttggtttttaaacactctctctcccttttaggtaagtgtgtacaggtgcatatgatagatttcaaatgtgaagtatacctacagggtgagaaatgtaatggacaaaatggggggttatggactgaattgtatcccctgaataatttatatgttgaagctctaacctctgatatgattgaatttggagatagggtctttaaggaggtaattaaggttaaatgaggctatagtggtggaatcctaactctatagactggtgtccttataagaaaaggaagagagagtgcacatctataggaaagactatctgaggacacagtgagaaggtagccatctacaagccaatgagggagcccctccccaaaaccaaccctgccaatgccttgctcttggacttccagcctccagaatcttgaaaaatgtaatttatgctgtttaagtcacccagtatatggtattatgttatggtagcctgagcagactagaacaaggggccatggtcaaatagtaattctacaatggaagaaaattgaaagccacattgagctggacctcttcatagacccaactggagagccatgactttgtcaagagaatggagaaaattcttatcctaatatgacataatcttttagcccagtaccttttaaatagccttgttatactggatgtactataaatttatcttaaatttatcacttttgggggaggatgttctaaactacattttttcataagtttatgagaacaaaaggagtagaatatgtagataagtatatattcataagatgtatattatgtatatatacataagaatatgtatgtgtatatatttgttccatcttaacttttccataaagaatttataactcacatctgtcttaatttactttccttgatcaccgtgtctattagttgccaaaaggaaatggaaaacaccaatatatcttgttatgtttatactgagaatattctgtcaaattggttggaaaaaaactagaaaatacaaagtcctacagtatcaaggatttaataactattgaatgtataaatgataaaaataaaaagagaccatgaggacaaaaaagggagaggagagtataccagctaggatgctatcagtggcaagtaataaaatatccagtataagcagacttaaataatataaggctatattgccctaattaccaagaagattgaaactatgcttcaggtgtgggttgatcatggtggcaattccttatctatattatttgcccaggtccatgtatcagcttcatcctaaggctggcttctctcatggtagcaaagtagctctatttgttccaagggttcatatgaatattccacactgacaggaggagagagtgtcattgtttagtaggtttatggagttaactatgctgcccccatgggccatttttctactttatgcagactagccttctaaagaacctagcatatttgaggagtaacttaaattacagtgcaagttctaagtcagtgaaagagctgcctggccatatcttttgattccaaagttctgtaggacagaaccagcacattttacaaattggtttagaattatacaagcctgtctggtgtattatggggagaggtgtccctgatggggcctaactggaaagagagacaataagatcttgtattggcacccaagttgctgaaataaatgaccaaaaccttgattgtttaaaataacagtaatttacgctttcacagttctggaagccagaattcaaaaataaaggtgtgaacagggttggtttcttctgaagactctaaaggagaatatattccatgcctctatcttagcttatgggtgattttggtaacacttggcattttttgacttgcagacacatccctgcaatttctgccttcatcttcacatggcctttccctctaggtctctgtcttcttttatatctcttataagaacatttcactggatttaaagcccattctaaatctagaaccacatcaccttgtgatcgttaacctaattatatctgcaaagaccctattgcaaagtaatctcacattcacaggtattgaggggttaggaattggatctatcttctagtatccactgttcaacccactacagatctcttggagaaaattagcatgagtgaaggtccaggcagtggaggagcagagtttctaggcacatcttaattctggcaaaaagaagagtgtcatttaaagcagcattctcccaaggagggggatgtgaaaatatgttggaacttctctttataattttcttcatctaaggaaataagaaataaataatttttctaatattgggcatatagatggataccatggccctccctgggtctgtgggtcatgcaggtacatgtcaggtacaagaggcatcctgactttgggagggggatgccacacagatgtggggctgaccgtcacacgctttttcatccttttgttttctgtgtttcaggatccattgctgtttacatgggcccattaaatggagttatgactattttctagtttatgtaagttgaccttcacaagacgaacaattacctttaaatattgtttctgactaaagacaatactaagaatgcattagtaatagagaaaaaataggaagagctgacacttctacacttaagtggactcttatcagcccaagtaggaggtaaaattatggtaatctaatcagatataagaagcatttagataaccaaatttcaaattattagacagctaatatttgtattatgaatttatatccactgttgttagttgttaccatcactaaagtccatgatatgtatcgagacagtagttattaaaagtacatatttggggaatgtgaacttaaacatattttattaatggagcaaaatttttaaactttggaggccattggtttcatggaaataaccgtgcatcacttggggctcaatagctttacttgaaaatcccactaaaaagtgagtcatgagagtcttgctagccctttgggtgacaagagaacagaaccataggttagcaatgcaaggtaggtcagaaattaggtgcccagcttaatttctgttctgcttagctgctgtctgttctgctatccaatgccaatcaagtagagcaatggccagagtagtggagcgacagattctacttatatgtgataattcaccatctccagcctcttaagcagaattctatgcaccagtgtcagttatggaaaggggaacactgtatacaaatttccaatcccagggggactctaaaacctcaccagtttctacaaaggtttctaagtgtggaaggaggtttttcacaaacccagctgccagaattctacaagagttcttgactctggcagggactcaaaggagacacggctgcttcaggggtcatacctctactacttgcattcttagctccagtttggtaagaaagaataatgataggagtcaggcaaagcaactttattattcaaggataggcagctaaaacaaacaaacctagaatccatgctgagtcagttccccgagtctcaggaaagttgcccagggcaggtggagccttatctgttcatgcccacttcatactgcagctgagggacaccaaaagcaatccactatgggttttacaccctggttgcccctgggttgctgagcacaagcattgcaggatatcctgttccaggagggatgacaaagcctgggctattctaggtggtttctccttatgtcaggacactgtatcctcagcacatgctacagttttcccaaaaactacagcagaagggggaagaactgggtcagccaaggctctctggggccctgtcttcctgcacacattcttcccctgttcccaccaccggcacttactaattgacactatagacagaaaactgagcaccttggtctggaaggagacagtgctccagaggaatgttttgtagtttggttgcaactgtggctcaggtgtacatcactgtggtaaaaaaaaggaggaaagaaaagcaagaaaacagaaaaggaagaacgtgaagctaatgttgggtgtcagaaaagtcctaacagcattcctttaactcgtttacttttgtttgtttttgttttttgttttttgttttttttgagatggagtctcactctgttgcccaggctagagtacagtggcacaatcttggctcattgcaacctctgactcctgggttcaagcgattctccggcctcagccttctgaacagctgggactacaggcacactccaccttacccagctaattttgtattttttagtagagacagtgtttcactatgtaaaccaggctgatctcgaactcctggcctcaagggacccacccgcctctgcctcccaaagtgctgggatttcaggcttgagccacagcgcccagccccattgcttactctttcactgctctacctcttatcacaagaagctggcccttcaagccaagccaattcccaggctcctatgtcagctgcttgcatttgaccaaagggaggcattggcaggagattggagggaagaaagacaggaggagcctgggtactttcttcccctctctgagtcttaggtggcagctacagtgctacatctcttccgtgatctacctattgacatccaggttcattttgatttcattggcctctttcctctctctctccagcctaggtgtggaagcagccttctgctatttctgatctctaagtgacttccctgactcatttttggcttgtcaacttcttaattccctgtgtaaaaaatgcccttaaatttcctttatttcaatacaataactaatttctgttttcctggttggacaccaacatatcctttaaggtagaagtagataggtgatcatcattcaaattttatattttattacttaattgcatggtgttttccatttgcctatgattttattttttagctaagatatgttctataccttttcccctttgccttatgaaactgccaagaactaatttcatttttgatgtcctgaagggatattattagaaaagggatggagctgattgataaagcaaaaatacaaatttataattggtgaattgcagatcgatctatatgatgggaatacgttctaataagatttttttctctcatttcctccttgcagatggatccctgaaagcctattatctttaatataaaattcttatttattatcttttaaaggtttggaaggatgagagctttaaggggaaattgagtagagaatgagattaggaaaggatttcatgcagagaaagaaagatatataatgcaaactatgctatggtctttgcatatgcaaacaaagcatctgacctactttcaggaggccacactcttttgagcttttccagtaattcattctctcttcccaccaactctaccctgttagaatgcaaatagttaggactgtaatgtggggcatggtatagaatagatgttgacaaactactaaggcctgtgggccaaatctagctcacagtctgtttttgtaaataaagtttcattagcacatacctatgcttaattcaagtgcttattttctacagcttcttacatgccacaaaggcggatttgagtagttgcaatagagacaatgaacctgcaatgttgaaggtatttgctatgtagatctttatgaaaaactttgctaatccctgctatacaataagttgcttgcttttaagaggattactatgatctttttgcttttcaggtgaaacatttctggagcacctactgtgtgctaagtactggctagatgctttatagaataaaagcacaggccgggcatagtggctcatgcctgtaatcccagcaatctgggaggccaaggtgggtggatcacttgaggtcaggaatttgagaccagcctggccaacatggcaaaaccccacctctactaaaaatacaaaaattagctgggtgtggtagcacatgcctgtagtcccagctacttgggaggctgagacaggagaatcccatgaacccaggagacggaggttgcagacagttgagatcatgacactgcactccagcctgggcaacagagcaagactccgtctaaaaaaataaaaaaaattaaaagcacagatatgaaatgcaattaaatttttcatgtagtaggataagaatgacacctgcaaatttaggttagacaagggaataacatggatgcttagaagatacagacaagggttgttccagatgacaaagaaactgctttcgactaagatagagaacacaacagcaggggttaggattttactttcttttcaaaccaggaaagacaagagaatgccatcctcctgtgtgtatggagaaaacaaaagctgaacacagttatttgtgctttaagttcagcctgttggacttcatacactttcaaggaaagcagggcaagaaaaaaaaagattaaggtcaggaaaaaggcagtttttggatgatcatcaattcatttacccatttacccatcaacgtttgagtgccctttcttccaggcatggtatgacatgctgggcatagacaataattgtagcagaggaggttcctgcccccagaaaacttttattctggtgggtggcacagggtgaatagatataatacatacttccagctcagcagactaacaaggatttttatctcagaagaagatttaggaggatctttaaataaaagtgcaaggagaatgtgttgaagattcaggggagtggagagtttgagaaaatgggttcaggatccagctgcctgggttacaatgggtggccctttagggtgtacagctcccctttttgggaagttactgagtacctctgtgtttcaggttcctcatctttaaactgggatgataatagaatgtactcataagactgttgtaagcattaaatgaggccatgtctgcaaaatgcttaaagtagtcagtgcttggcacatagtaggagctatgatgtttactaatagaagaaccaacctgaccctttgtttttactctgagactgtccacgttttaattattttttttttgtgatagttccaataggataagtgaacaagtctaagaagagagaactgttttgttcttttttatattttaaatgaaagtacttgagggtcataaaatgaagctagcaagaagttataatttaattagcatgccattgtttatctacttcatctggaataattaacttcatgtatacaagactgctgcttccaaagatctcaaaatattttctttgaaaaatgcaattttccactgaaatatgtagaatagaaagtcaaattataataattatcatcatcaaatatttatcaaatggttatgatataccagtcacagaaagtggtcttacacattctggctgggcacggtggctcacaactgtaatcccagcactatgggaggccaaggtgggcggatcacctgaggtcaggagttcgataacagcctagccaacatggtgaaaccctgtctctactaaaactacaaaaatcagctgggcgtgatggtgcatgcctgtaatcccagctactcgggaggccaaggcatgagaattgcttgaactcaggagatggaggttgcagtgagccgagatcatgccactgcactccagcctgggcgacacagtgagactgtgtctcaaaaaaataaaataaaataaagtagtcttatatattcattaactcttttccttaattttggaaatccataaagctgatattttatccccatttttcaaatgagaaagctcagatgggcaaatagctcagattctattcctaaatcacactagacatgaggtaggactccttcccagggctacctgactccaaagtgtgtggtccttcctctttcttatgtgatatggtctcaaggacacattgaaagttgacatttagaacacctacttcatcttctttcaaaaagaaagcattagtaggcaaaattgtaaaatgtatccatcattttatcaatcataaaagcattacatatttattacagaaattttgaaaagtttagaatactatgaaatagatatacatcagccattaccctagccactagaaatatccattttaattattttatatattttcaaaatttctttttatacaaacacatacacttctaaatggtttcctactacattatatggtaagtcagacttcaaatttaacatgccatttagagttgtataatattatttcaaagtctacatagaatatttgtatggctgtagtacaataacacttaagcagataccttgagtgcttctaagtttttacaattataaataattttgtaaccaaattctttttttttttttttttgagttttgctcttgttacccaggctggagtgcaatggtgtgatctcagctcactgcaacctctgcctcctgggttcaagcgattctcctgcctcagcctcctgagtagctgggattaccggtgtccaccaccacgcctggctaattttttgtatttttagtagagatggggtttcaccaggttggtcaggctggtttcaaacttctgacctcaggttatccaaccccttcagcttcccaaagtgctgggattacaggcgtgagccaccgtaccccgcctaattttgtaataaaattctgacgcagtctttcagtcttttattatttccttaaaataaaatgactgggttaaagggtaaaattattttagaattgctgatatgtatagacagactgttctccagaaagaatacaactaagtcaatgtcaacttagctaaagccctatcggaaaataaaaacatcgatatactttcctcacttaaccattaggcaccttactaattttcaggttatatttggcactgaactgaacaatacaaaaatactttgagcagtatgtcactcaccttctaactttcaatgatatatgatccaagataaaatcattcaatctatgattcccacactcaagaaatgtttgcttgcccatcattttcaaaaagaaaaataataaggatgggtgctaaaagtacaaatttggctgggcgcagtggctcatgcctgtaatcccaacccttagggaggcagaggtgggcggatcacctgaggagtttgagaccagcctggccaacatggtgaacccttgtctctactaataatacaaaaatagccgggcgtggtagcacatgcctgtaatcccaggtcctcgggaagctgaggtatgagaatctcttgaactcaggaggcggaggttgcagtgagccgagatcgcaccattgcactccagcctgggctgcagagagaatccgtctcaaaaaaaaaaaagaaaaaaataaaataataaataaataataaaagtaaaaattttagactttgcatgtgttcctgagtggatttgtgtttgtgtgtgtgtgtgtgtgtgtgtgtgtgtgtgtgtttgcgcgtgcgtgcgctcatgagtgtgtctgtgtgtgttggggaaggttgaggtgtagtgatgtggagtattctcgggagtttcctaaagtcatgaaatctatgaacatgacaagcatgctgggtataaaggcatctccagcaacatagtggcagccaaagttttttataggaaaaataatctgcttcccaaaaagtagaaattaatttcaaagcaacattttataattctacactttattaaattaatacttataccttggaaatagataatcaagttctgaaccatgtagcactgaaacactagtgagagctgatgatgacagaggagggcctttgccttctgtgacaacaaaagcaggaacaaagagaagcagacaaaagagtgagtgattcagtcacactgatggctctaaacggagaaaagcctaaacaacactcttaggaaggaaatgaggatgagctttcttggcccaaaaacctggtctggctccttgaaagttcttgaaccaagttctagtttctgaaaagctcatggcatatttagggtttggttatttttctgagactatttgtaaggttctctctgggtttctttgagacctagattatgttaaatctccattacttgacacaatccgagtaagtctatgattgttttttttgttataaaaataaactaatacagcaaaatgatttctgagggttctgaagtatcagacttttccacatcatgtgatattagatcattaggaagactggacaaataaacaaagaaagaaacaaaagaacagccactgagaatgaaaaagagaaaaacattgatcctgtttcataatggggttgctgtctccctagaaagacaaaagtcgcttgaaagaatccttttcaagttaaaatcatgagtgtattaatattatgtcacatttcctagtctctacctatctgagctcctgagaaccatatagagatttgacagcagaaacaaaaaattacaggaccataaatctttctgttatctgtgagcaggaaacaggctctatgaaaggatgacaagaggccctgatcccacttgaaattaagacagtaattaagcaccaaaataaaggtaacaattgagaagaaaatgtcctctagtggaaaattctcattaattcaatttgtattgatataaataatgttcctcaactttcttttgaatgatatatagtcttttaatggccaggttgtcagtggaaggaaaactaatactttattcgttgaagaggttcaaataagcaaggatcatcctccatggttgaaaatgaaaaaaaatcaatattgatgtgtttaagacactcttttccacagttgttgaaataactttgaatgtctcataaaagacaaatattttattctaggaaaaaattctaagaccttttactacaaataatctgaaaaatattaagcctaggtaccactatctgcctactgaacctccctgaaataaaaaaaaagtacatgttgaaaatgaaaatttattattagaataaagctactgttaatcagaatgcagctaatcagaatttttagttaatttaagaaattagtttgttccagtacaaaaaagctgggtacacagtcacacagagacacacacatccagacatcacctcccacacacaaaaagatatggctggtatattgattaatggatgactattaatatataactaaatatttatatgtatcactaaataatatacaaaatgaatcaaagtactttgtcttatgatatgatcaaggacataataaatatgagcgagtgagcaaaattaaaaaacaactcaagatgctaccagattaccaaataagtggtgtcaatacctggtttttatactggacttgaaacacatcaaaaatagtgtgctaatattagcaaaatttctaaaggaaatgattgtcttttttttaaaaaaaaaacaaacgcacttaagacttttagaaaatcagtcaatcagctggcctcccaaatatttaggaaaataaatttaaagtgaagacatgaatgctaggaaatataagaaagaaaatttaaaaggaaaaaataagaaattttaaaaaatgaaataaattagtattacagctagcctgcttaaaattgcataccgaaatgtttgatataaagactaagtttttggtcatgtatgacttggtgaaagtttaatgcctttaatataaacagcaaacactattccatgtgaagacgtgaactaaaacacatcctgtgtcaaccacatattgggttgtctctttcttagtcttccacatctaaacccgaaaacaataatgtaataccctatagcatctttttttatccaatagaactttatccatataccaaactgtacacaggaaactgggcttcgtaaaatactttatgtaggacaagaaggaaagtagaccacaactcagttatatagcagtttcacctaattgggcagtccttctttgggtgttctaagcaacatcttgctgtatacaaacaaaactacaatcttgattatgttcttaactggttgatcttccttgttcaaaagataaagtagataatttgtaagatctctaaaaaccatagtattttagaagtgtaaggttgatcttccctgttcaaaagagaatgggttaaagtggatagtttataaagtctctaaaaatcatagtattttagaagtgtaaggatccactatttgaggaagggtaaccagttattagcatcattaactccattttatacttgacccaatatattgaagacagttgcctacaatggcacaactatcacatttcttcaaatataagacgtacacagctttaaaacaaagaaacaaaactgccacttgaggagtggagaagactcgttacagagccagtgctgcctgtgcctttggaagtaagccttgcacagagggttcattcaatcatcaacgcagttaattttcctggcagaaccacagttatatcttaacttaaaattgtaatggaaatgtacattcccgttaagatttcttcaaaaacttccattaggagacgactttgcaataaaaggtgactgcatatggagaagacagcatgccacatgccagggaaaacaaaggccatagaaagtgtcagatccttcagagtaggtctgcgaattctcagagactgttttgtgattgatctatgtgtcacaaaagactctcacttagacacagagcatctacttgtcaaaagcattttgctgctataccagaaaagctatttaacttaatttttagaaatatatcattaaatcaaagaaagacaaatgaaagtaaaaattttaccaactaggaaatgaagaggaaaccctgaaattgttcaatacaacattacttttaaagcagttgaaaaggtaaagatttataatttaggagactcaaaaacagattggctccgtaaacctttaaaaataatgtataaggtttgctagattatattcttggagaatttttagatacttgatgttgctacagaaaataaaaatagtagccatgtaatgaatgccataatcagctaaagaaacacccagtacctccccaccagtacctcccttctactgatgctattattaaattgatggtgagttttacataaaatagtaatttaggattagagaaaacagtacttgatgataaagctggaactagaaattcagggcttcaaatttcacatccagtgaactgctaaagacttttataactactctgtatttacaaagaatcttatatacatatctcacacttctgatgagacatattgtaagaaactattgctattttttaacaaacttttgatatttgcttagttgtatttattactattctgatacatagaactagaattggagaaattatctctttctatgtttctggaaaggcttgtaccatctcagaatagtttgttatctaaaataataacaaaaaaaaaacagggactccatagttcaacataaaaatgaaagttagtggttttcaaatattacatctctctataatagctatcattaccttttgatttccctttgtcatttgtgtaatatatatctccagtcctatagccttcaatatgatagcaactagccatatgtggctgtataaatttaaataattgaaagtaaaaatttaattctagctgaggcaggagaatcgcttgatcctgggaggcggaggttgcagtgagctgagatcaccccactgcactccagcctgggcgagagtgagagactctgtttgaaaaaaaaaaaaaaaaaaaaaaaaattagttcctcagttgtgctagctgcactttcagtccctagtagtcacatgtggctagaggctattgtattggatagatatagattgtttccatcatcacagatagttagttctatggtactcttttatgacataagaaccaatgtttttggtcacaggtaacttggtaagagaagtttgacacctttagtagcagtaaacagtgccacagtttcgttaaacaaatctgttcaaggattcttggatgctatttaaaatgaatgttaaggaaaatgaccagcctcaggttgtaatcagtagatgtagatacatgtatgctaaatttgtaaggtgagctagtcatagaattgtatagctgtaaagaccctaggaggtaccataattcaactcgtcttattttatggttgtggaaactgaggtgcagagaggctaagtgttctttgtaatgtcacaggggattttgtgacaataatcatcagcattggtagtgacacacattctcaaatgttgaaataaagaaaacaaaattaattcttgcactgaaaccatgcagtgttcccatctgagcagatcaagcctggcttatatgcctcaaagagaccaaattcaaagttctagtctgagattggttgatgtattattttcatttggttgttcttactattcccatgtttgcctgattcaactaggaatatcctgtaaatgtgccataaaatacttgacttagctttagcaaaacatttgacttttgtgaggtttcaatttagctacacctgtggctggttgagggctgagcatctacagagtacaagattgttaaatctagtaagttccagcctaggcattccttcttcatttttcctcatttggcttgctactgaggtgtcaggaaattgtacactcaagtctcaccttgacatttagtagcattgtcacctggcacaagatgcgacatatccattgcaacctgcccacccacccccatttctgtggtaagttgctctgcccttgcttctgcaggagtagtgttcatgtccgctgcttctccaccttctctaaccaggacgaaagtggtttgcatgcaggtagatgcttgatccacagacagctgatccataagtgggcctttaacatagggcatacatggcctggttcacaagaatgagccaggtaaacagtattttgaaatttgcaactaagatgttgtagggaccaatttcccctttgtcttttgaagggtcactgaaaatcaaatgacaaaaggcatattaataggagaaaagacatataagtttgataatgtgaatgggaagaaaaatcacagagtgattatcccaccacacaatggggtataaatggctatatattcttcttcttagggaaaggagatgaagaagtgaagatcatttaaaggggttagcaaatgatttttaggagcattcaatagcaatggacttgaagaacatacagtggcctgggataaaatctattgggcctgcagagcagacaactgtttgtgacaaaagtctgtcaggtgtgttgacagacttcagtctttcttcctgcgatttgagtttggttaatgaaaactcagaggaggaacccagagtaattgtggggttttttgttgtttgttttgttttgttttgtttttggtaggttcagactttacacagataagggaacttcggagaacagcttcattcagtgctttaggagagacagaggattgagagacaggaggtggggaagatcagagagaacttgcgaaaattctgaaaattttgaatgaggcccagttccagtttgtcagaagtttggctttctgacgactttctattgagcttgcatgagcactaggtctctttaatatatttttgtctttttagttaaataacttattttctgtaatttgcaaattaaacatacatactgaaacaagagctagtagtgacagtcttaatagtttactgccacggttgaaggataaaataaagatatcatcccccagaaatctgtcaattcttcttaaggtcttcagttatatttggaaagaatgaagctaaataaaacacattttcctaaaattattggaaacaaaaaaatagagttaagataaatatttgagttttctgaaatgctcaatttgtcttctacaatttccaccacacatttaaaaaaatgctcagagaacatgagcctgtggaaagaacaattgtctaagtaccaggaaacctgggtgttagatccacttctgtagtagaaatgactagtgctcacccatatctggttctcctctactttctggacacatgaaatatacatttcttggacccttaataaggaccctattacacttctggctggtagactgtgagcagaacttatacatgtcatttttgagctgcagctataactggcctggcaacccattcacattctccacctatcacagtgattctgaaaggtacaggtagagatgatgaagctgcaagatggagaatgcaaagctgtataaagtcatgtcttggaaaagagctgccctagaaaactacccaaattgcagcagactttgcattaacaagaaacacttttgagggctaagcccctgtgtattacagtttatacgttacacagcataacctatcccaccctgacgaggtagacttccagtgcctagataaagaagtcactgcttttccctatgctctgacttcttcaagcatctaaatgaagaaattggacttcattgcctccagtgactcttttagggtgtgcattcattctatcattcttctctgatgcctgccctacttactttgcagatttgctgagagggtgctttgaaacacccattgcatgggccttcccattgcatccttataaacaaaagattttgtcaaagttgaccgcttccaaaagagatcttgctatttctgaattaagcatttggagtgacgtcaattttaatttttaatttggctatgtgcaaatctttatcctttttggtgggaaaatttgaatagacttttctctttgttttgccagtattcaaaagcacaattttgagagtgcaaagaagcataactgacttagcaagtctgttagctctgctctcattcttcttgacctgcttctcttcatcacccaattgtgaatcttacctcttggtccttagctactatcctgattctacagatcagccctgcccaaaagtgcctgctgatagtcactgccatgacttgtaggcatgcttctgtaataatgtacacatatggtcttgacaggaaagaatctgctagatccttcacactcagtatcacatgattccagatacagactaaagatcaaaatattaccttggaaatcacaggttagaaaataatagctggttggtgagaatatttaatggtttgcatccagacaacttgagactctagttctgaatctgccacttcctatctgggcgacttttggcaagttacttaattctgtaaacttcagctctcttctttgtagtatgagttaacagcaagtacattatagtgtagttgagaaaataaaataagacagcttatgtaaaggacccagaataatgcttagctccataactagctacaaatgccagttttttcatttatcttatatgagggaggtaagggaagattatagatgttactgaccaaagggaaaggcctggatagagggaattataggagtaaagctatcataaagaccctgaatacggagaggagaaaccaagaagaaaatgtataattctcttctaaataaaaatggtaattcttataaattatctatttataattttgccctagactagcactacactatttttgtcaagaatgatgattaaaatttcttccattggcctcatgctttttacagatttttcccagttgagtttcaggtagagaagatctgaagaatagagatggaaaatatcattctttttttaaagaggagttctagagaatctaaagtttttttttgattgttcaatagttagtatccaaaccattagaaaaactcagatcttaaaacagctaaccagtcgggcgcggtggctcacgcctgtaatcccagcactttgggaggccgaggcgggtggatcatgagatcaggagtttgagaccatcctggctaacacggcgaaaccccgtctctactaaaaatacaaaaaattagccgggcgtggtggcgggagcctgtagtcccagctgctcaggaggctgaggcaggagaatggcatgaacctgggaggtggagcttgcagtgagcagagattgagccaccgcactccagcctgggagacagagctaggctctgtctcaaaaaaaaaaaaaaaaaaaaaaaaagcaactagccaatagactattcccacctgtaaagccttctttttactaggtatggtggtgtgttggtcatcaagtacacagattaacaagacaattcctgccctcaaggggatgaaaactgggtaagaaaaaaaaatttttttcagtccagcttgttaaataccatattggagaaaagcaaagttgtcagtggaactcagacatggggcacttaagctatcaaggatggaagtgctccgtgcacattcatgagatggaggtgggaagtcagacaagttctggcagggacattccctagctctgtccaactagtttagtattagctggcttctcacatttgggtgaggtttatggtcatcgaacttcctagcctccattaggaaaggtatgaacaatcagtctgtgcttctaagcttgattcctttggattttaagtgttttctgtttcatgagaactttgttaaaatgcaaattcctcataaatgtttagccttatcagtcagcaccatattgggaatgaataagcactgtgggatgtctaaaggaagggagttaagagacaggctccagcaaggagatgatggtaattggaaagatgtacaacagttccaaagacaaactatattaacttctctttgtggaccaaggttaggcaagacttctgtcgaccagttcttggaatctttggctcacttcaaccgtaacttctctataataaaaagtaagaaaagtaaagagttcattggctcagagcaagttaatcagaaaggattaaagcacatcaatctattttcatgtttgatagtagccctcattgaggcttgtgggacaatgatcaggtccttattgagcccagcagagaaggaggacccaatcttgctttatttctccccctaccctctttagtgctattttttttctaaaattgccctttcctttgttcagttcttcatcttctttgacaaggaattcaaaaactctcagaaattttaataaataatttacagtaaatatttatgacttaatatgtcatatctaaataaataaattgttaatgactaaatcaacacaacaataatgttagtaattgaatgttggaagtcacagacttcagcccataggtaaatctcccctctgcacacccatataaaaggataggcccaacaaaagtaatgaaactgggcattataatgggatcttggccatgagacacgaggaaaagaaaatatattttttaaatgggttgatggatgtttctatttataccaagtcactgatgttggaaagccaaatgagaaaagagaagaaagtttttatctaagaaatgtgagcccctttaaattatcaggcccagagaggctttaaaatgtgacaacagtcacatcttacttcccctctatgctaaacgattacctcttgaagccacttgctccataggctctagattaactgatgccaagtagccataaaatgccacacactggacaccataacttataacctatagttcaataacgtataatcaatcactaatcaatgttatcgctgtattgtccaacagaccgccaggatggctaaatagtataaaggagagctttattggcaatatcagtttgcaaaccaggaagagacagtctctggcatgtacctaaagtgctttctcttcaaagaggtaaaaggcaggttgatttttatacctcacagtctgtattacacaatagactcatacatactcagccggtttggggggtatgaggagagtcaagcacatgcacaaggggtaaacatatatgtaacatacttcccatgttcactttgaggtagagttttagcattaaaacaagctggaatttggctctttacatcaaaggtgaactttaaggcacaaagacagtttgtgtgcagcctctgaaagctgactgaagctggattaaagtctggagttgcttaagaggaaagaatgtttgaaggccactcccctgtccaatcagagttgtagtgatctgggttataaataagaggtagaaagggagtaacaatttgcttgatagctcctattgttaggaagtttagcaagagtgtggggtttttttgtttgaagctgtaagaatttaggaagttgctatgccagctgagctctgaattctgcgcccatagataatatttattttcttaaccttggggtctgtcttagttgataaaggagcatctattttggtttctcagatcacatctgtaaaccaacaaaaattcctgtcaaacaacttcgtatcagcccactctttttttcccttttccctttgaaaacctgcttgtaacaagccaaatgcagcacttcccagggcaacttggaaatgtgtcccagccattgtcctcactttggctaaagtaaactcttccattaaaattatatctgatgcctcagcttctttctttaggtggacataagtcatttcgaactcctctctatccaccgcactacgcatattcacattttttccatgtttttccaattttgagtctgatatgcttcttgaatcagtttttcaccactttccatcacctaccacctctgctctgcatcaaattgtcttctgctcaaatcagtagactatttccttacatgaccttcttacctttagccttggctcccttagatccatcttccccaaagtttccaggtttcaaaggcaacatccgatgatgcaaattctctttcaatagctccacatcttctttggatgatgctcagagcttctctccagtgcatctgaagcttttcatataacgatgatgaagacggctgatttttactgagcattactatgttccagatacattggatcagatcttttcatggacattacttactctctcaaaatagtcccctagaatagatgtgattatcctccttatgtctcttttacagaagaagaaaccactttcagagtttatttgccaggctaggaagtattggagaagagatttggtccaatgccagtcattaagtcttcccctgaatatgtgctcacaactagtatattacacttccctgcatctcctaaaccgaaatgacaaaccaaaacattttagagacccaatgtgtaagaataattgaatggaagtgatttcagcaaaagttcttctataggctgggtgcagtggctcaagcctgtaatcccagcactttgggaggccgaggcgggcagatcacgaggtcaggagatcgagaccatcctggctaacatggtgaaaccccgtctctactaaaaatacaaaaaaaaatttagctgggcatagtggtgggcgcctgtagtcccagctactctggaggctgaggcaggagaatggcgtgaacccgggaggcggagcttgcagtgagccgagattgcaccactgcactccagcctgggaaacagagcgagactacgtctaaaaaaaaaaaaaaaaaaagttcttccataattcagttgggaagagctaaactagccagccatatggttcagatgaaccagtgatctcctcaaattgatgtccagtgcctcactccccaaggtaaatagcaatgaggaatggttctactgacctccttaacttgtcataaaattcacacttttattcgttgtggaatgacacttttaatatttcttttgtagaagaaatccaggtttccaaaaagccactgacaaacatttcaagttaggcctggtggcactgcacttaaatcagtagttgaatttaatcatattcatttttgcactgaaatatttgtttctgtaactattgaaaaatttcactttgctgtttttttctctaaatgatcttttatttcaattatggaaaaatagaaaataaagcttctgaaacctatatctgtcagaaataatcatggaaatcattgggcatgtcaatagccatgttttaacatcaactgaatgccctttaagcaggccacctgtagtttgaattgtgcaggaaaaagaaaattgcaaggataagctcattttttcctgggaatatttcatagaaagttgtgctcaaagatcaaagtatgattagaatttttaatattaagctctgggaatggaaattctctttttatcatacataaatatagtttgaattatgcatagtctatcttcatgcatgctttcagaaggacatttctcagagagaggaagatgcacatggctttctaggttttccacctggaaaaggaagaaattcaaatgtttggatcccaattttcccagcatcatccttttcatgtccttaaaatctcactcagagaagctatttctttttcactcctgatagcaacagcgtgctgttggcctggagcttgatttgctgtagaggcagtaggctggggcttctctggggaacactgattaagcaggaattctgggagcaggcgatggctggcagagtggtggaagtgagcctgtgagggcagcagcagcacacagaagctcagtgtgcttctggtgacaaggtcttcagagactcttcctcgaggctggtttgcagctgggaacatcaatctctctcctgaccaggggcttattaacattctgagtatcactttcaattaaatttctccaatgctcatttagtttctagttaataaggcaggactggatgtcatgtatgatccagcaggttgtttttaaaggataaaaataaaaggagccctgggataagttaaagcgtgaggcactgttcctgggccaacatgttgcccaaaccactggcctccattggctttgcaggtggtctcagggcatgttttttaatgtacttttccctaatggaggatttcaatcagatattcactcttaggaaaaccaacacattgttccccgatggctgcacaaattcaaccagcttttttagttcaaattattgtgtgttttgtgtagtaaagaactcctataaacaaagaatggaagtagtttctaggaggtaccacaaatagaattcgccagcctctgaacagcttttttgaggtgataacgctaataatgaaaataatagcagtgagagtcactacttattcagtgtctattatctgtctatcactgcggtcagcacatcacttaaaaaccctcatttaattattacaacaatgctaagaggattaatgtccaattttggatggggaaactgagatacagagcttaatatccccatgatcaaagggctcatttgtgctaatagagaagtggtaactgtgtaaataataatcagtgtttcatcttcaggcttttccttcttctcttttccatctacttgaaagacttagaacagtgtagaatagtctcagcttcaaaacaggtctccacagacttcttggcgaacagaccactaaggtagaagggtgataaagtgggaggcaggcagggagaaggaacatagccccctttcctatgggaggagccaggaggagaagatgcatacaatcagcactttctgctctaggtcaagatgccctgcttattcttctaacctgggacagcagagacttgtcaagggctccaagattttggagttaaaccctaatctgggccctactatgcccttttctagttatgtgaccctgggaaactgacattattctgagcctcgggtgtttgtaaaggcatgactctcccaccctctggttaaaaaccttaatcctaggtgacaggagtaggtacatgaaccaggattggtcattcatagtgtctgtcccattctcttggacacataaatgactcagaaatggacttttgacttctgcaagccaggtctgtccagagaagcggactgcatttggagagggttcactagataagtaagattttcaaccagcctttgaccctactctacagggtaaaattacagaatttgattagattacattctctctacgtccaatgagctctaatcgtctattattccatctgaaggaaaatacacatacagtgtctcattccgtatagttggattatataaaattacacgtatgggggtggtgcttgaggcaaaatctgttaggtagtaatgaataactaaaacaaagaaatgctttaaaaggagttttgcaaaatggctctctgcactagagtttggaggtctcttttgaaataatgtttgaaaaccaacccactcacaagaaactttgtaatttttggtgtttttctttggcatgtgattccagacccataatgggagggaggtttaacggagacagggtttataaaatgctgagcggctgtgattagagcacaacggctttgtatagaaatgtgctaacaagaaacaataagtggcatttgaaataagaggcccaagggagaataggaattcatgaagaaaagaatgttaaaataaatacttgctgagtacctaatgcattcaaccaaaagcaaaacttttaatacacatttccagttgaaaatcagaaggtggcagcactgcttactgaatagtttcagatgaagcctccagggaaacctggagacagaataagccattttgtaggttataagcgcagctaatttatagctaaaaatgaaatgactatggctcatatgcacccctgaaacctctgagcctcttcggggatttggcatattgactctgtcatgggtgggtttcacctccaaggatgcagtgaactcagaaacatgccaaaatgaagagcaaggccctggccaaatttctttccatctgaaatgaaaaaggaaaagcccaaagtttggtccccacaactgaaacatcaaagtcccctgggaatttgtcagcaatactagttttccagcctcccctcagatctactgaatcagaagttttgagagtgaggtccagaaatgtggattttctaaactttccagctgattccagtgctggcttacatctgagaaccataaggagaggtatagagactattgttgtgatctgtgtttcaaaatgtggaacacgtcctcaaacaatatcttgctatggatatgtggactaacttcgtggtcctatttatagcctcagtcatattgaacagaaagagtgggcaaaaacagacgacttgcaagaaagtaattccttaaaaatggaccagaacaggcagtaattgatgaaagcacaaactagaggttttccccacaacatattgaatttctgcctacttgtcaatagctcagaaatcttcagaaaaataacttgttttgctgtgtgtcgttctatcagacaaatttacaagttattaaagagaaataaaactttgaaaattatttttaagcattctctgaataaatgcataataaaaatattatttgttcttactgtccaaacagaaaaaaaaaatgctggaggtgagaagtcaattacacttaaaaagcataaagactcttagaagtaattttgccactttaataggcattgactaaagcctagtccagaataattcatgcctgttttattaattaactttgtggttatacagtggagagtagataatagggccatcatgtccattaaatgaaagaacaagaccacagagggcaagaccacagacaaaccacccaaagtggtggctggctattctcagaggccttcaggagggacagtactttggtgtggtcatgaatttccaaggttttattttaatttggcagatttataaagttcatttttgcctggcatgcagagttgatcagttttgcagagatagtctttgtaaagaaacccacaatagagtcatatcaatattatctaccatgggttttgttttttgtttttttgtttggttcgttgtttgtttgtttgtttgtctgagacagtcttgctctgtcatccaggctggagtgcagtggcaggatcttggctcactgcaacctccacctcctggattcaagcgattctcctgcctccgcctcccgagtagctgggactaccgacatgcaccaccaggcctggctaatttttgtatttttaatagagacagggtttcaccctgttaggctggtcttgagctcctgatctcaggcaatccaactgccttggcctcacaaagtgctgggattacaggcctgagcaactgcacctggtccagcttttttttttcttttttttttttttaaacttgctgtgagccacggaagagccagccagaaagtctgctagctgatccacacatagccttggcaaatctaaatggagggtcaaatctggattgggaatggatgtgaagaacacaatatcgggtcacaaaaaaattatctggggcatcttaatacactaattcattcatctccactgtggatagagacctgtctctctatttgggtttggaattcacagcctcgttactcctggacggtatgtactcagcttctctgactgatttgtccatgctctgtgccaaacctcccctctcacttgaggcttttttttttttgaagtatgttaatatcatttattgagatttagttatatgtcattaaatttccaagaatgcctggtcatgggcaatattttgtctttattgtccttgattaacagcactgtacttctactcctgctaataatagtgtcatatttttcttttaatttggtttcaaggtctctctcaggagagcagctgtaaactctagccctgccctgacagtgctcttggggaggtggttgtgggtgtttacagtgtaccttccgtgggatacttctttgttctggtggaaaacctgatgcctaagtgtccaacgtgtgaccagatatccctctcacaggaaacttacttacactggcagatgcttaaggtcttgtgtgacctatgtccaatttattcctacaaagatagccattctgtaggagaactgactgggaaataggttcaggtgtgttggtcataggaggtggcacaacaaaacacatgaaatagcagaagcagtatattactcacaggtcccagagaagaggagcaccaatgagcaccaatgagaaggttgtggggacaccatgcgcagccaacaggttgggatttctaattggtggacttagagcaagcagacaagggtcacatgcattcatgttataacttaggagtgatcactacagcctctgagcacattccatgtggagtatgggactcagtaggatgagcctggtcaattgttatctatttttcccatatgaaagtggatactaggaggtgattttatagggaagatatcacgtctggatggaatacaagaagaaactgggaggaggaagacagctggaaactgggtcaaaggtgactaagctctgcttctggtgtgacagttaatgctatatgtactaaaaatgaatgccgaggcaacataaaattacaagtattccctatacatagctatcatgagagctcctaggtgccagagcctgggaatattagactgcttagttctagacctcctgaagtttacattgcagttaagaaaacaggaaactggacacacgactacaatttagtcatatggagcatgcaaagaggggagaagttgtggatgccagcgcataagagggagagtggtccttaattttgaggtcagagaaagcttcctctggcaggtgctaaactccaaacattagcagaaaacaagagcttttacagaccaaatgagttcacatggctttggcacacactgtgtggggattgggggagagagtaaaatggggaaagatcatgctagagacataagcttgtgtgagatcaagaaggatttaaattaagttgccgaagagtattttatgttggtggtaattgtgagacaagtaatagttttgagcagaaaagtgactacacgtaatttgcattttagaaaactcattcttatggagaaattatactatggattgaaaaagggtaatgtttgagggaggaatgccttgggttttcttgttttatttgtttttcaatatagatggctaataatggccgatagtatactcttactatatgccaagcattttacttgcatgttctcatttaatttttataatgatgctgtaacatagattgcactaggaattatcctaatggcacagagaagaaaagaaatagcaataggaagtttatgtaactcccccaaggtcacaaaactggtatgagttagagctgagatagaaactctatctgacgtcagagtctatgctctatttcactgcacccactgctgccttcaagctagagagaagataagctgaattagggagctgcatccagaaagtaaagaagaggacacattgggagctattgcagagcgagaaagggcaggtcttgacgactgcttggaggtaggtggtgcgagaagggagctggtaagaagaagtcttaagtttggctcaagatcattactaattttgctcccaacttcagtaacttcctctatatccttggacagtcttttcacttatttcctggtcccatctcttttgcttcacagtagcaatccaaaaattcctgctttcttctgcagacaccatgctactccatccctcctcagcatcaatggatgattacaccttctgattgttttggatctttggctgggaatggtggtgatgttcttctttgtgccaggtctaaattaaagaattggctctttatcacaacatttagaacatactatgaaaagaaagaaatcaatgaaaaacaggacctctttatttcctactcataataatatcaagtaagaacatctatttccagaagtagtttttcagccttttgctagagagagtttgttcttttgtttaaaatgcctgagctgataaggttcccagcctcaggagggacagatagagaggagaaaagttattttcccagaaatggcaggatgcattctgaccccttcctttatgttttagatgactgatagtgacaacatctaatagcaacttttattttctcatttagggccagtaaggctagcttttgctgttttcaaatgtaattattatagagtattgaatataacgatccagagaaagatccagatgtttctattttcttccgtagaaataactcatctattagatataatagacagtgccttgtggtacagcagtttaggaatatcattttactaagctcatctcttcctagatgcaggaaagtgaggactaagctctgatttttttatttgcccaaatttctatctaaggggtctagggactaatgacctacaaaccataaattctcatcagataggttttatttaaccctatatatcatggcttactttccaatctgaccctggcataacactatgagacaaggaagaaaataaaaatatttaactccaaaatagatttccttgccataccttgaaattggcctgcaaagtcttttatgggaaaaacccacattctatagagaattcccttttgttttccttccttccttcccagatccaagagataatcaactaagagtcaggcacccttttaggtcccataagaaatattttgcaacctgctctctctctctctgaagtctgctacctgagagctccctctgcacaataaaacttggtctccacaacctttatcttgacctgaacattcctttctatcaatcacaggtctttaaacaaactcaaccaattgtccaccagaatatgtttaaatttacctatagcctggaaacccccactttgagaagtcccgcctttctgaacaaaaccaatgtatttcttaagtgtatttgattgatgtttcatgcctccctgaaatatataaaaccaaactgtgctctgaccaccttggacacatgttcttaggactcccctagggctgtgtcacaggccatggtcactcatatttggctcagaataaatttctaaaaatattttacagagtttgactctttttgtcggcaaaagattatcacagaaaagtgtctgaaatggtctcttaaaatagtctgtctctcagttctagttgttatttgcaacagatggaaatactagtctttgtggcatggttcaagtatgagtttgctagaactgccatagaaaactaccacagactagatgagttaaataacagaaatttattttctcaaagttctggatgttggaagtccaagaccaaggtgttggcaggtctggtttcttctgaggcctctctccttagctcatagctggccaccttctccctcatgttctcacatgcccttttctctgtatgtattcctgatatctcttcctttcttatatgggtaccgatcagattgcattagggcccaccttaatgatctcattaacctcatcacctttctgaaagccctatctccaaatacagtcaaattctaaagcactagggcttaggatttcaacatacgaattttagggagacacaattcaaagcacataattgtatttactttgctgttatccaaaagcaatagcaacagtgagaaaaagcagaaaaagagctctggcctagaaaaaatatagaagtattacaagaacaccacccagtctgataacatttccaagctttggcaccagcgaatttttactgcttgcaaaaaggcaggcgtgaatttcttctgttggggtagccctattttggtttccctaaaaaaagcaagagtttcaaagtttcaagactctagaaaatgtaaaaatctttcagatggtttttactgccattctttctctgtttcaagagctaataaacacactgttattatcatattagttttatccttccacttatgagattttctttcttttccttttttctaatgaccaagcaaatcccctttctatgagcataatgaaggattttgcttacaatcaggcgtcaccctcaaagaggtgaaatatcttggctctttgataatctttcatgatcacttccaagaggaactttgcaggcatttgagttgccagacgtaaaatttggctttctgaaaaagaagcacatgtaactagctcataagctgcagtttgttaattatttttttctaaataaagaaaaaatatcattgaccagagtgatgagtaggagactttaggactctaaagagggattttctcaatgttcactctcacttcaaccctccccctacgcagaaacttctctacatctacttgtatatttgtttcttcactactaccatctaagtatagtagaaactactactaagaagctactaagctacacttagcttctactatacttagatgctagtagtgaagaaataaatatacaagtagatctagagaagtttctgtgtagggggaggattgaagtgaaaatgagccttggaagaagcatctaagtcatttccaactcttcttccactactgtgaggaatccatgtcctcctttctctgggcctttgcatttccaactatcccctctctaagtaatgccatgctcctccctccactgctttcctcttctttaactctgtgcgtgctcatgcctcctcccagatatatgatattatgatacatctacctacattcgagttcaattctgagtttctcaagtgcaaagatatgtcatatctttgtgtttccactgcctagcatgattcctcgcttattgttatttcttgataagcatctgatgaatgaaggaatgaatggatggatttacatgcatacagggcaaaacaacagaagttgattagtcaagtaaacatattttaatgatggcaataattgtttattgtttagaaaaataaaataaaacattcaatttcataaaagacagaatctataaaatcagaaaaatttatagttaattatctggatagtaaattttctgaaaataggcaatgttgataatttaggtaaagcttactgtctccttcatttttctgaaacagaaatagaggtttgaatgattttcaaagatgatccaactttcctcttgctcttggctatgttctatacagtgcaaattgagaagataaaacctaaacatttcattgtagtttgtctgtgttcatgatcacctggatgttttgcatggtatagatgtactcaggccttaagagactctctcagaatattcaggattctacttagtaaccctaggcttgctagctatttagtgggttagttttttaactgctaaatattttctgagcccttactaaatgtacagtaattgtgtcaagtattaggaagaacatagaaacatgtataaatgtaccttctgtaattgttgccatctacggtattatccaagacaatagacactaaattaaaacgaaatagtagagaggaaatgcttatgatctttaggaattgttgctaattgaaaaaacaaacaaaagaaattcttaacgttggcatgtttagtggtaattaggacctgtttttattgcatgctggatattagttgttatgtgcttattctcagctcattggaatacaagcagacacatctccaaaaagcagaataatctcaggaagacgttgccctctcctgagctaggtagaaggtcttgagctgtagcctgaactggtgtctgattgaagaatgcgtgcaggtgcctcctccatcagtctggtcccagaagacatcttgcagtttactacaagtttttaagaaagatgcagcggtctgtgaaaaggctaacatttctgcaggagagagaaatctgcctgacagataaacatccctccagcctttcctaagccctatttgtaaagaaagcttgatggaaagggaattctgtacaacttcaaggaaaaacagtggagagattgaatcaataggaagcatcctccttactcccatttcaggaaatccagagatcagtgtgctcttatttcaaaaggctgtcatccaacagagtcacatggtgatctgaaatcaccaaagccccagaggatggcacagggcaatgcaaaaagcatgaggctgagagtcaagtgacatgggttctgttctcagttctgtcaaggtttagctacatgaccttgggcaagccacataagcctgcttcctcagctataggacccagattgttttacctttgtctggcaaagcttttacgagaatggaatgaggtataatatgtaagtggacctgtattattcaattcttacattgctatgaagaactacctgagactgggtgatttgtaaagaaaagaggtttaatgcgttcacggttctgcaggttgtagaggaagtatggctgggaagccttaggaaacttacaatcatgacggaaggtgaaggggaagcaggcatagtcttcacatggccagagcaggagagataaaaagagaagaggggagtgctacacactttgaaacaaccagatctcatgagaattcactatcacaagaacagcaaaaaggaagtctgctcctgtgattcaatcacctcccaccaggcccctctttcaacacatggggattacagttggacctgagatttgagtgggaacatggagccaaatcatatcagtactcaactcagtgcttggcatatggtaagaacaaaaccacaaccatagctagaggcctttctcgggcatgagcaggctgtctggttggaggatttcagggagcctgagtgcactttacccattattccttctctcactgctatgggacaccttccagatacatagcttctcagctgattgcttcagtgacttaataatggataaactgcttcttctatctctagtggaaaaaataaagcctgggacacagagtggctcaaaggggagcactagcctgtgtggggagcactagcctgtgtgaggagcaccggcctgtgtgagaatccctgctcaactcctgctcagctctatgaactttgggtgcattcattgtttaaagcctcagtttccttatctgtaaaacaagggggctagaaatatggggtagaacatttgaggtggactaagatggaaaaggagaatagtaacttcccactgacctgtggccctttcagtggctgctctgcccaagagccatatactcatgacttctgatggggacaaagacctaaagcgcttgtggtaattgtcctggaatccttccgcaattctattctttctcctcttcagtcgtttatttcttccagatatgtggggagagcttagggtgcctcatggaagcccagaagcccacccctgaaatgtctcccctatcctaattcaagacaggtatggcctgcagttcccagcactagaaatagagtttcccttcaactcatcccctatttactctgcccatttcctagtttgaggtttcaggatctgagtttgctatcaggattgaaacatcaaagtaccttagttttttgtcacatttgctaaatggttgtcattctacaaaatgttttgtacatgttaggaaaatgataatctaaataagggaattaccatggaggagtttctttgagagatttacgtgcaggggattttctaacacctctttcaaccccttttccacctatccataagccctcttaggaacaaggcaagccatcatttgtcaattcatataaatatgattaattgtatgaatgacgactgaaagctaaggtcaatttctgatgtagaatctatgttcttggaacggtggctcacacctgtaatcccagcactgtgggaggccaagatgggcagatcacctaaggtcaggagttcaagacaagccttcccaacatagcaaaaccccatctctactaaaaatacaaaaagtaaccaagtgtagtggcacgcacctgtaatcccagctacttgggaggctgagacaggagaatcgcttgaacctgggaggtagaggttgcagtgagccaagactgagccactgcactccagcctgggtgacagagcaagactccatcacacacacaaaaaaaagagagaaagatatctgtcagttttacctgccaggcattcatttacattcttctggtggcaacgtttagattttcctttagggaacttctccattgcatgcaatctcattgttattttcaaactaagagcccctcattcttaaggagtggaaggtaacccagtctaactcaatcagactatctcttctcaatacatgtgttttcagcaaagtggctcaaaagtgtaaactatcaccaggtcattcattcatcataaaaactgtggaagtcagtgttgcaattcctctgggatctagaactagaaatgccatttgacccagccatcccattactaggtatatacccaaaggactataaatcatgctgctataaagacacatgcacacgtatgtttattgcagcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactattgtaaggacaaaaaaccaaacaccgcatgttctcactcacaggtgggaattgaacaatgagaacacatggacacaggaaggggaacatcacactctggggactgttgtggggtggggggaggggggagggatagcattaggagatatacctaatgctaaatgacgagttaatgggtgcagcacaccagcatggcacatgtatacatatgtaactaacctgcacattgtgcacatgtaccctaaaacttaaagtaataataaaataaaaattaaaaaaaaacttaaatgtacttctattcttgctccctagatattcagagatatcttgtttctatccttcgtatgatcaggttgttcaataattcctccaattctgtgggctatccccttccaataagtttatttttcactctaagccagatgcatttcaagtgcctgcaaccaactaaccagactaagtgaaaaatgaaaggaaaatatagcatatttttgaaggtctgatgttggaggcagaaacagactatggacaagtgattaggttgctttccaaaagtttggtcctatttcagtcgtttaaatttggggtccattttcttcatgggatagtttctgtagtatatactgtacctgaaatatagacttcatgataccatagtttagagtaattttgaataatgattattgtgaaatctgttgagagttccaaatttaaaaaacattactgggttccaaattaaatagtttatttcctgtgggatatgtggataacaggtactttatatttgtggcatttatgttattaaaataattttacaaggtaattttatcttcatttttctgttataaagaacttgaagctcaaatagggaagaatcattgagcttatagaagatttggatgggaacccagctgtcctttgttacaaagcctgcactcctacatctgtctaccaaagctacttaccaggcatgcataacctttctgtaccttatcccagaaccaaaggagaatatctgcctatcagaagaaagataaataatgtgagtttctttccactattattcttgcagttcagggtaatttctgtgcagcagcaaagactaagagagccacataagaggagagctggatgggtgctaatgatggagagagtgtcaaggagaaaggaggtgttgggagtaggtgctctggcttaaaattcttggaggagagttcactcctatcctctccttgtttctcatcttggcctataggaacaggaagagaaagcagtccggagtctagccccctattatatgttcaattgtgttccccaaaaagattttttgaaattctaacacttggtacctataaatatgaccttatttggaaataaggtctttgcagatgcactcaagttcagatgaggtcattagggagtctctaatccaatgtgattggtgttcttataagaagaggagaacaccacgtgaacatagaaacacacagggagaatatgatcacatgaagatggaggcagatgctggagttacgctgtcacaagccacggggtgcccaggaccaccagaaactgaaagaggcaagaaaggattcttttctggagacttcagagagaacatggctatgtagataacttgattttaagcttctttcctttagaaatgtcagagaataaatatgttactttaagccaccagtttgtggtactttgttccagcaggggatttacctaacaccacaaggagtcaacaaaccagttgcctaaagagccaacatctcaaaaattttacctttcataagtgcagatgtacaaaaaaggtatctcttctttactgagaaaattttaacatttttacatatgtgcacaatacttacacaaaaagtcaacattgtattaatttactttcatggagtcacatttgcaaagaaacatataaaactagaattctctaacagcctttccataatttatacctccagtacaggaaatgatgcaaagatgaaatacatagcacagcaaattgcaaaaactaatgttgactaatgttaaaatagtgaaaaaaaattaaaaaggaaaaagaaaaggagaagaagaaaaaactaaaaaatatttggcatatgaaaagtataatgcaggaatagattatgagcaatggcacgtagatagttcctaagagctggctgatttcacaatcattaactatattttgaaatcttgcatcacaattaatagctgcttttttttcttttaatacatgctttccttggagaatacattcacattcattttttatgtggcactgcttttttgaaattcttctttgattcagcatatactaatatgagcattccctattacattttcccatcttttgcaccttgtttctatgttgttttgggtatgcagaaatccattttgcatgcactcaaatacagaccacacatttgaaagaaacaatactggtgatcgaacagcaacactgtgtgtttaagtgttttcttatcccaccatgtacataatcatttttgaaccagtccatcagcaactttgctggcttcttcaggcaaatgcaactttaatacattaaaatctcctggaagtcatcagctagaagaaatgccaatgcaggcaaacgaggcatttttaaactgaagttttagtccttgccatatcgtgtggacaatgcacacatttgaattttttgacaaatgcattgagctaaatggaagaaaaaaattttagtaacaccttgaaattcacttttagaagtcttaatcacacctaattccaaatccatcactatggttcagagaatcaactgaaatccattttcttctgcgtaaagacaaaagcaaggtaatagctctgcctaacatgaagcaatattcctgtgactgtgatttttggaattcagatgttagagattttagattttagggattttgatctttagggattttggtctttcaggctttcaacatttataattatggtgttcaagagtacatcttttgggattatgattcaaatcctgattccccaactgtcttcgggaagaaggcaatatcatgttgtgagtttatggatgaatggaaaaggaccacagcaaagttgaatttgcttgaagtttctttttttttctttcatatccatacccttgcatggaaatagaaaaaaaaaaaagtagctcgtaaagttaagaatatggataaaggcaggtaaaatggaatttttaaattttgagaaatcacagatacaattattacaacctctataagtgaaaataagcaatattcccaaatctacaaaatgtgaatcctgtaaaagtgtatcaagagctcagcatccttagcctctctgttgattttgagtgtcaacgctgcagcccactgattgtgtgttctctttgtgactgttttctcacctataaaataaagattgtataatgaactgagtttgctcatctgtaaaaggtgaggttgtaaggattaaatgatttaatacttataaaatgtaaaacaagaagtttcatagagccacatgggaagtgcttaatacgtgttagctattgatagtggtatgtcctataaataagattgcctgtcttgtcttggtggtggatgtgatcgggttcaaaaataaattgggttttggtcttgtcctcaggtagtttgctaataagcaactttattacaagatcgaaggttataagtattctaagcaaaaccccaatttctaggccacagatactgaaaaggatacttcccagcaatggtggcatttgaagtggacttgaagcaaactgatatttaaccaagcagagttctgattacatggagggattggcacaatcaaagcacagaacagtgtaaagttcctgattcggttgagtagaggacacagtgattggacatgcaacatagctggacagatctgatgatggcatgccctgctgaggattctgaaccttatttctatgggcaacaaggagtcatagaagatgtttgagcaaagagtaataggattatagcttcagctgtaaaaaggcacacacaaaatcagtttatctaaggagactattggaagtgtgggaagttagagaagaaaaggccaatttggaagctattttcaacaatcgaataagagacaaaaatcagtgaagactgaacggtagttgaatttgtcattgggaggagttaatgatttgtatcagaagttaggatggcctgtgctaacattagaacatgaagatcagagagggagtgattctgagcaggaagtagaagagaatgctaaataaagtgagctatctacactgacaaataagtttgaaatagaggcagttatgcggagaatgcaggctacaaaatggtgttacatgtagaagagggataggcgagctatgacctggtggaatcttggttgatgcctgtgtttgtacagttctttggctgcttttgcactataagggcagagatgagaacctgtaacagtgaccatatggccacaatgcctaatttgtttttttttagacggagtctcactctgtcgcccaagctggagtgtagtggcacaatctcggcccactgcaacctccacatcccaggttcaagcgattctcctgcctcggcctcctgagtaactgggactacaggtgcccattaccacgtctggccaatttttgtatttttagtagagacggggtttcaccatattggccaggctggtctcgaactcctgaccttgtgatctgcccattttggcctcccaaagtgcttggatgacaggcgtgagccaccgtgcctggccacaatgcctgcaatattaattactgggccgtttacaaaaattgttgctgatccctgatcaagaatatcttgataattgaagtaatatttgaactcaaattagctaatataactgccttgttattccttttgaagtgttttgaaaacagcttcagaggtttcaaagactttactagaagcttgggaactagcaagcttctaaaagaaacatgtggatggaggaggtacctgcctcatgccagagtttactactttattgacaaaaggtcaccacacaaacatatgcaaacaatagattttgtttatttaatctatcaaacatatgcaatgatagattttgttgtatttctccaggaagaagaaaataaaaggaacatattatcagattattttaattcaaggtcagaatttttttaattaaaattggattctagtctgcaagtgagtgcacagagagcaaaaagaaatacatggtatgatggctgccctctagaaatttttaattttccacaaacaaatatccatatataaaaataaatgaaaataatataaggaaatgctgactgtactgaaggagaagtaatgtgataattgatttccatttctttcctgctttccgtctgtttatagagtcacggacaaagacaagtgtctacagaaactaaatgttttgaacatcaggacactttaaatacaaatccagagaaggggcttctctttaaatatcacaagaactggcaaaagttggcttgcagacctcccaagtcaggaggcctctggaactggccgtgtgagcctctgttcacgtagtccccactgtcctttctcatctcatgctgagtcagctttcctaatttttatttcccattggtctttcaaagcaattgacttgtaatccttgctttggaagtgctatcaacttcatcatggttaacagcagcagagaagggagcccctaacaatgtgccttgctgttagtttcttgactacttttgtgccatttcccactgcactttcattttgtctctccttttctttatttccatcactagttttccaccagcaggaaattgccagaaaagaattacacagctgaccctctttcctagtccctgtttccttttattcacctctctttcatcctattccctcttgtttcaatccttacccaaatgtcttttgaaatgccaatagaaataaccatagtgacactttgctcaatagatgtcccagtggttcaaagagcaatcctctttggcctcacccactgggttctatttctgctgagccaagtacatttaattcactcgttcatttgctctgaccctgttatcagtcttattttttctttccttcctctgctcccagatcagaaaaatcaatacatttgttaacaatgtaaaaaaattaaaaatcagtcaaagaaatcagggaactaaagtttcaaataggtaagtgacttgcccatagctgcggaattcagtcttgcatgatcagtcctcaggagatggaagtctggacttgatgtctctggagcctagggtgattgcagggatggaacatagggctatgaaaggttgacctgagaatgatgctagaaaaagtgagcttctttcttcctttgcatttgatgagcaaaccccaaaggagagccaggaaacagattgttgtttagaactctgaataaggaatcaaagcaagctgctctaggagttttccaatgacaaaatggaaatggaaacctgaatgagtaatcacaaggaacaagatgctattatctttcttcagctgcctcatgccccctcttcacttaagcataaaatggataaaaatcagaaaaacaaaacctgtcaatgaaacattgtttctgaaactcaggttgaaacataaaagagacttccctaggctagtcactatatatacactgatatatacatatatgtgtatacattcttagaatactctctaaatatcacttagttctgaatgatgtactgtgtcatcttagactaaaggtcaagtgaaggagagttctctgtttctctcattaagtaactcatatatagataagagaagaattgagggagaatgatgagtctgccctttcccatccccggttctccacatttagatgttagtcacacacacagtattattcctttaggatgcttcttacctgataactttcctttaagaataataaactgttgtccttcactattaaaaatgggactttggtctgtcttcctttttatcagtcttttatcctttgtaagtgtgataactataagatcctttatttaagggccgttgaaaggatttttagacacaaatactatacttttgaatataaatataccaaagtcacctccaatgtacattttccatcacttagctgcattcaactgtgttgatatagaagcatttgtcatatacagcattagcatacacatgtatgtatggcattttaaaatgataaaatatatagaaatacaaaaaatgtatgagcacagtttaacacatggctgtaaggggaaaacctgaaaccattcctaagtcagaaattagaacttttcagaaaaatatgaaatgcttcatgagtttcccattcttcacagtttgttctttcttctctggatcattccagttggagatcatgggcttctgtatttttagtattattcttggttactacagtcccacttggttatttcattcaattcctaaaaatacttatttgaactttgcacttctgttctaaattttctagggaacttttttttctcatgtaaacactagatcatctcatttagttaatgcattcctcggagaatgtgctctaaaccagtgccactcaaattacggtctatcagtgccaagctgtaaactgttggttactggccccccatgaaattgagtgtagagactgagagtaagctcttaaaatatttatagcaatttttcaaagaaattttatgacttgaatccagtaataaaaaaatagaaacttgcacattttatctgtcatttttattttatttttctagacatttatttttattccattttacagaagtatatatccatgaaaaactggaagtaaaacaaaattaaacaaaaatctgttttcgtttttgtttttttgttttaccagaatagtttgagaagtgctagtgtagggagcagaaactgcttgcaggctgcatttccctttatggacccgtgagaaacatgcatcttgagcatccaaatttgttcacgtaggacaaagggaattttcttttttttttttatttttttttattttatttatttatttatttatttatttatttatttattttaaattttttttttattatactttaagttttagggtacatgtgcacattgtgcaggttagttacatatgtttacatgtgccatgctggtgcactgcacccactaactcgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgcgtcaaatggtatttctagttctagatccctgaggaatcgccacactgacttccacaatggttgaactagtttacagtcccaccaacagtgtaaaagtgttcctatttctccacatcctctccagcacctgttgtttcctgacttttgaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagcccttaggacaaagggaattttctaacatgagctgaagatctggagttcccagccatgtcttttataaagactcaacttccagaacagaatgggttgctttacttctatgttttcaccagcacctttcttgcccaatgactgccagtcctgtgccatgtacctcttttcttacccatcaataatggttaaaaattattagatttagaaaaggtatataaacaaagacacttattctagcactgcttttattttattttattttattttattttattttattttattttattttattttttgagacagagtctcactctgtcgcccaggctagagtgcagcggcacgatcttggttcactgcaacctctgcctcctatcctcttgccttggtctcacaacaagccgggattacaggcatgagccaccacacgcagtccaagcactgcttttaaatatcaaaaaatacatgaacgccaaagagaaaagcgttagtacactaaatgatgctgcatacaatgatggcacaactgcaatcattccaaattatgttgtaaatttgtcctagatcctccacataatgctgtgttaaggaaataatttaggctacaaaggagtatatttagtgtgataagtttttgtaaagaaaatatatgtgttcagatgcagagaaacatgggcataaaaatgttctcaataattatcctttagtggtagaaatatgtgtattttctaagttttttcccttgtgcttttctgtgttttgtatcaaatacttttttatatgtttgtttaaagtacataaaagaaatgggaaagaataggagaactgtgaaaaaaatggagagtcaagtaatccaaggcaaaaatgtcatgaaggcaaagtatgttgaaggctgagtggaggacaggaaacaactccatgcaatggcaccagaattttggaagttgttaaaaaaaaaataagataaaaaactggtctcaccccagaccagattaatcagtattttagaggggagggaacagacatcaatatatttttttttttttgagatggagtcttgctgtgtcgcccaggctggagtgcagtggcacaatcttggctcactgcaaactctgcctcccaggttcacaccattctcctgcctcagcctcccgagtagctgggaccacaggcgcctgccaccacgcccagctaattttttgtacttttagtagagacggggtttcaccgtgttagccaagagggtctcgatctcctaacctcgtgatccgcccgcctcagcctcccaaagtgctgggaatacaggcgtgagccaccgctcccagccacatcaatacttttaacacttcctcaaggagcccagtgttcctccaggtttgagagtcgttgggtagatgccagccagcctattctaccaaattagtccatgctggctggctggctttcaggaataggagttacattattccaaacagaaggctaacaataaaaataacaggattcgtctctcacaaagcattttatcccctcagcattggtggcctaaagctgaggattatttgtatgtgattacaagttttggagacaccagttgaaattatctaaacattctgaatattaaaacctaagtatttaatgtgataaaactatgatctggaagttgaatggagtgattgctttgcgggtatacagagctgcatctaagtcaaccctcttgaaaatgttaattagcaccaaacaaagaacaatggaagatgtctgcttttttccttggagaccaagatagggacaagtcgttttgcatgtgcgcagaatgtggaaatggcaaagaggtttaaataacgaattttaataagtttcatcccactgggagagacacttctgattatctgtgacctatacaaattatcatgattctccccactggcctaccataattttaataagtaatcaaactaagcttgaaggttctgcaaaatgccaaatatatacaagtgcttttgctagttacaaagctagtacttgctacctgacctttttacaatttctccaactacttattcacaccccagccacaggtttaaatgctcagcgttcatttggtccttattgatcctaggctgctacctgtttgggctgagaaatgaccttctgtggacatctagggagtcttgccctgctgtgagaagaatttcaaaagaagtttggccagaaatttaatgcagatctgaaaaggttgctagcgaagctacatgtagtggaatgagatacaataagtccctagtgatggtccaggcccaggcaagtacctaagcacaatggcgttcaccaatgagctagcagaaggttaacgagggcagagcatatagaaacaggtgcttcgggctcctgggagatttctttacctctctccaggtttcaatctatttcctcactccagcctcactctccaaattgtaacttacatgttgggagcttaagctgaaaacctcattaaaatcttgttctcttctcctgccccgtgatttggcttttgcatccttgactctacaccagtactttttaaactttaatgtgcttaccagtcgcccgggattttattaaagtgcagattgtgaataggtcagtagatctggcatggggcctaagacatgaatttctaagaagctcccaggtgatgcttctgctattgtgccagaccacagcatgtgcagcatggccccagttactagttcctacccccagaatttatgaggcagttgtctggggtggggccaggaatttgcatttctacttagttcccaaatgatgccaatggtcagggtctacacactgagaaccactgccttagcctgctgctcccaactgatttgagctgtcactactcagaagggcaggttgctgccccttcccctgccatgtgctggttccccctactctcttggcagttttttcagggatgggagtcgaaagataatcatcttcttactcttcaggtatctgtaagatagaaaaagaaatcctgccaaagttgaagaacgtctcccaaccttttagacactgaaattctatagaaatagagaagaaaaaatgaaacaaagcaaaagaaaatgacccaactactcagattagagcctcgaattaaaaactgacagacaggctgctttacatcatcctgaaattacttgtgcctggtctcagactaaggctcctgcctatagctgtacagtaaagatatcagtttgttactcaccgccaagagcctgaggaggcaggactcaaggttctgttcatagcagagcttctcactgtgctcacacttgtgcaggcatcagactgtcctgcagggctgttaaaatgactcttggtccagggtggggccagagaacttgtgtttctaaaacgttctgttactcataggactggtaccagaccacacttagagaaccactcaaattgaatgacacccctgttttacttgcttccgttttccaccaattaagaaatggcagtcacaggaaaggaaagtaaaatcataggtttgctgatgaagctgaaatggggaaatatggtataggcagagattgtcaatggatttcttaaggctgaaccccagagttagacatacatgtgcacccactcacgggcagcactggatcctgtgagcatcccttgatggggacctgcccatggaaaatgtaagacatggagaaacagagtggggacacacacttcctgcaggcagctagctcctgaagagaatgaggaggggaaggggaggaggtgggcaagctcagttccttctgtcaaacccaacaatcaggtaaaacactccacactcccaaataatgcaggaaatgagggactcaagaaagatcaggtaggatgagctaggctaatggatgtccctcccttagaaacaggaatagtcaatcaatagccctcctcccaaagaaactaatgtccaagcttgccaaccccctcccacaccaaataccaggctttttgccccaatgagtttaatcagtaactaaattgagttcaaattctatcccagcttagactggttatttagcccgtatgagccttagtgttatgcctacaacattgggataatgtaagtcttatctccagtgatcgctgtgaggattaaacaagctatcactttgtatctaggagggactctccatataacaattttccttccttctctgtcttccttcatctcttagccttgtgacttgatatgataaaatatgttatattgtacttgctcttagaaaacctgcaatctcgagaaaaagtatagaaatatgaaaatgggctgggcgcggtggctcacgcctgtaatcccagcactttgggaggccgaggtgggcagatcacgaggtcaggagattgagaccatcctggctaacacggtgaaaccccatctatacttaaaatacaaaaaattagccaggcgtggtggcgggcgactgtactcccagctgcttcagaggctgaggcaggagaatggcatgaacccgggagggggagcttgcagtgagcccagatggcgccactgaactccagcctgggtgacagagtgagactccttctcaaaaaaaaaaaaaaaaaaaaaaaagaaaagaaatatgaaaatgttaaatacagcataaggcaatgttttgaaactatgaagagaaaatagtgtgaagactaaagcagatgatatgtaaaatgcttagtgattagtagttgcttagtttaacatttttctaaaaatcgcagttcaaactggaagattgggaaagaagctagagttttctatagtggctccataggaaatctgtggctttggttggcttcaggaggaaagccaactgctaatcatgggacagggtaaggatagttgagggatggggaacagcatgggccgaggcttagtacaagggacccgagagacaggcggacacacctggatgggtggtcacttgttctgttcacaatcagttcttgtcctgagccaatcaccagacttaaaaggtccccacgctgtagtcttttatatcattgcccattcagttcgcaggcattgagagcataactagtagcaatttctctgccttttatgtataatgattcgattgatttgaatgtcagggcatgtctctaagtctagagggtaagcagtccatcctgtgagggagcatagttatttttctttctttaagtcaatgactctctttgatggtggctgcacattcaaatcacctgggagcattaaaaatagtagcaaagctctaccttttatcaataaacttcaaatctcaaagggtggaggctggcatatatattttcttaagagctcttcagatgattctagcatgcggcctaggtcaggaaagtctgtggccaaggcagcctgttcactcgtgtggaaatggcatttctaagcattgatttttctcaggaacaattaggaagcaattaacaaacaattaaccagactgttagtatgctatagataagcaccaaacctgcatgggattttgaaataaaataaccaagaaaagcatgtttttcaaatgtaaactgggatactgttttacatgctaaataaatggcctggcaaacaaaggggctatatttatataaatggttaacttttagtcatgtttctaaatcacacgttattttgcaataaaataaagattatgaagacagaacaacttaataaaaacatgtacttgactatttgagttgagtaagatcatatttatcttttcttatgactaatagctagttggatattttgtttctgaagtggtaagctgtttaaacaagtataaaggagaaatcttatttggttagcaggaccaggaagtgaatctatgttagtgtccagtttccattcattaacttattcattcaataaatatttattgaatttcctccattgtgtacctagcattagactagaaagtggttacactgtttgttttgttgctgttgttatttttagagacagggtctcactctgttacccaggctggagtgcaatggcacaatcatggcttactgcaaactcatcctcctgggctcaagtgatcctccccgcttcaccctccagagtacctgagactaaggtgtgtgccaccatatccggcaactatcagtattgttgactaaagcaggtttggtttctgaacttctgttttaggtacttataatctaatggaagaaagatgataataaatgatgagttgtgctaagtgcaatgaagaaagcaaacaggatatagcaattgaggaaaactgtgtgtgtgttttgtgaggtgttctactgtgatagaatctgaagatcctatccactcttctgaaccaagaatgcagaataaagtggagccaactttcagacttagagcactgtaaggcagaaggcccaggcaaagaagaatttagcctgtgagaggctctgaaagataaatgtgctaaaatagggagtagtcacacacatgcattcatgataattatttttttcctcagtttgttcttttgcatatctttatttttccttttaagaccaattgaagtcaatatttattgagtattttctatgtgtcagtagttaaaatagtctgagacagtgctaggaagaaattaaaaaaaaaaaaaaaaagaaattaaaacctgatgggagaaacaaccctgacctaagagaggcagattgtacttgctcttaaaaaaagtgcaatcttgagaacaagtatagaaatatgaaaatgttaaatacaatataaggcaatgttttgaaactataaagagaaattagtgtgaagactaaaggagatgatatgtaaaatgcttagtgatttgtagttgcttagtttaacatttttctaaaaatcatagttcaaactggaagagtgggaaaggtagaggtgtctctaagaaagacatgcatacaagttatgaaagtgtgtgcagtcagaaaaaggcaaaggagggtgtctagctttccctgggggatctgcaacatcaggcaggaatttttccatgagaaggccctcatagaccccagggaatcatggagatgatccaaggatgtttggttggcaacagttaagctggtgaggaggaacacattaattagttatgcctagataagaaaactggagagtcaactcaagtcagctttccaaatcagtcatccaatccgaatgcttctaaaataatgaacaattaaaagtaatttcacactggttctcagttctagctgcacgttagagttacctaggcatcttcctaaagcactggggtctaaaccccactgcagacaaatgacacagtctctgtagggcaggtccaagaagagcatgggacgtacatttacgaaagatgatgaactactgcctcatcctcataggacctcagtcttcataagtagtgccaattcaatatggcaagaccacagtctctcccttaatctctacttttttttttcctgtctgagtaaatttactcaaagaaccagttcaaatattacctctaaaatgaaacatttatttatactcctaggaaaaattatttcttagcaaaagagttaaggaagccccgttgaggtattttgtacattgattttcctgtgattacatatgaggttacacagtcctcaagggtttgattgcattaaaatacatagcacctagcctaacgctcacaacatatcaagtcttgaatataggaaggaaggaaggaaggagagggagaaagaaatgaagaaaggaaggaggagagggagtaaaggaaggaaggaggaagggaggcagacagaagggaaaaaaggaagggagagaggggtggggagggagagaggtgggagaaaagaagaaagagggatggaagggagggagaaaaatgggcaggaggaagggtggggaagagggaggaaggaaggaaagaaagggaagagggagaaaggaaggaaagaatgggggcgagagaaaggaaggaagagggaagggagaaaggagggaaggaaagaaggaagagaagtagggagagggggagggaggagggagaagtaaaagaaggaaaggagggagggagagagagagagggaaggaaggaaggaaagaaggaaggaaggaaaaaagattcattaataagaatgattcaattagtttgcataccaggctgtgcctttggcagctgagggtgttcaggtaccagagacctaagagaaagggtacaaaaaggaaagatagaagtgccagggagactacttgtatgagggcttcagcagcatttttaacttaccatttgatgtttttagctttagaatactttcctcaaatatatataacagaaattagtagccttaagtgtggtcccctgaccaacagcatcttgggatttgttagaaatgcaaattctcacaacctgccccagacctaccacaccagcaactctggggttagggcccagcattctgattttgcaagcgtttccacgtgtttccgatgtgtcctcaagcttgagaaccgctggtgtagataaaagtcgacttactttggttgaaacacagctagtaaatagctgtcaattcctactccctttccatgcaaatacacacaaatacagtcctgtggagtctgtctccatagagtccccaagtcctcacacaacgaagttgaataagctggtcttgcaagtgtgagcctccctctatgttatacacagtctcagtgttgcctgactccagagttcccgtggttctccacatgtgaacttcaagaggaattatttctcttgatgacttttagattcagacttttgctaattcacacaatcccaaatctgatgattgccagaactttgtctgattaaaaaagaaaaagtcagttaaagcagttttcagtttggtatatgcagcctacccaactctgttcactttctaccaaacaatccttccctaatattgtaaccttcaagagtggtcccaaagccatccacacttctgtaggcaccattgacatagcatatgctgagcagattcccaagctgccatttcacccaatcatattttagacagttgaagtctttatttgagaagcattccgatctgagggttttttccctcgtctacttaaaatttcatagctgtgttaatttatcacccctcctcattgcgtagcttctgagtaagttatacagtaatggtgaatgataaatcagagggccaggcctatattactcatgacattgtaatagtattaatctgagatagcttttaattgtccgttctacagtctttaatgctaagaagatatagaggtttccattattctaattgtatttcaaataaatgtatgggctcaaatttttcctctctgttaaaaaaaaggctaaattagagatgtcttgcatataaaatgaattattttacagcaaaactttgattaatcacactgaaaaatagcagaaatctcaactgtatgtatgttgtctgcacttagtttgtcagaaaatgacaaaaagggtcagaaaataaggtttcatcgtgaaattaaaaaacgaaatttcaaaaaactttcaaagcaaccccctatgcctttcatatctgtaatctagttaagtgaaaatggatgttcagataacctgtggtccttttagctatcaagcaaaaagtggattattttcaaaggcttcatttgcaagataagaaatggattaatgcattttcaaagtactttcaacaagactattgagacaaattaggttaattttgaagttattgaaaagaccactttccaagtattccagtcaatcaaactttaattacagtaactacatatattgatcatacttagaagaaaaaggcagttacccagaaaagtgaaatttcctggtaattgatgctttccatatgaagcaccaaaacatttggatatgaactattgtggttgtagttaaaccatttgcagtctgactaaacagagaacagtgactgtctttagatattcctcatggcatttgtatcagttggcatcattcatacgagcacagtgaataaagcaggaactggtctataaagcattcttatctttcagacagtggaactcagtatatttactttcttctacattaaggagtccaagacgggtgctgtaaatcttttttttttttcttttaataaactctttagttttatcttcccctcctgctgtctcttggtggccactgctaaactaaggtctctagcaagaatttctatggagttctttgggtccatgtctgaaagtggccctctgtctatcttacttcacaaccagaaggttgtggggacaaggcaagtactttggaccagaaaagcagatcacagaagatttataagtgtttaggcagcagtaggtcagatgccagaggaataaattgagatcaagagtgcaaaatgagaattcccaagtatatgcgattagacagagcctggaaaattgccaggaactggtgggggtgggcagtgatgggggtgggtcagcacaagatgatgtccaagtgccaggccaaatagcaagtaagagatctctggaaattgaagcagacggacaaatttgaaataaaataaaataaacagaatttggaatcagttatatggaaaagacacagagaagcaattgatattttagcttcaatatttcttacttcttaaatcgtcaagtcacccacttctcaccacctgcaccattaccaccctaatctgagctatcatatctcttccataaacgctaatcctgtagaagtccctccagctggtctccacaggcaggcgatgccattgctggcccacccagatcctctttaccaggcaggtgcgtccatcccccagcagctatgagcattggctgctaatagtccccagcagctatgagcattggctgctaatagtccccagtggcatccttcctctgagaaccgtcctagcatataggaaaatacctgggagagtagcgcaccctccctttggcgtgcatcccccagccaattaattaacagaaatccaaaggctggctcctcaacttgaggtgagataaacctgtggtaccatgcagactccaggtatacctgtaggatcaggtacagtgaaaacagatgtcagttaaagcaggtcttcattgaacaaacttctaacctggaagtacaagtatttcattttcctcaattccttactgttttttatctatatattaaatatatatatatatattttcctaggccctctcccacttggacaagtacctatctctcaaaccctgcttctgggaagccttatataagatgcactgtcttcacatttgctgccctgtagcataagtaaatacagttatttaacttaggataatgccatatgatttgccaaaattgtattttgaattttgttctagacagaagaaattttatatcattaagatgagtgaaattcctattaaaaaggataaaagcgcaactcgatttctgacttcataaagattgaatattgtttcttactcattctacttggaaatagtcaagaaactctctgaaagtagaatatttcaaaaaattctgagaaaattaagatatttagaaacaaaaaggatagctgttttgaaaaataagtaaagtaagggaaatcaaaaaatttttcttgactactttgactttactgggtatatcacatacattaatagattctgatagcacttcagttttttgttgttttctccgtgttgcagctaaaacattggggctcagttgacttaagaaatttgcccaatgtcgtataactagccagttttaagtttgtcctaaggtatctgactccaaaccctttgtgcttttctttctgccagtgtacagtattccaatgagtgctaattaagcatttaaatagcaagaaaagcaaataaaaaaaagatggcgtactttcagtaatttaagtaaatctgggaaatactatatattatatccctgttgggagataattctccctggatctcatatgtttctataaagtctgagtcttatgagcaaaagcatttatagtcaatttaagactgtataaggaggcattccagaatagtagaggcacttttctcccctcttaaagagactcgctcgtatgcttgtattcctgggtactacagataatatctctctctgtagggcaagatagatgggtttgctagctgtgttgtaataagattgggaatttcctaagctcagtgttctcagatgtaacctagacccctttgtgcacagcatcctttgggtcctctgcatatcacccccaggggacttgaggagcagcggggaaccagtgaaagcgcagagctcaggatgcctcctgtgatgaaaataacaaactgtctaaatctatttgagctcactggctccttaccagccaaatctgtggaagtatggaaaccactgcagacacttcccaccatattactgctaagaaactgctttaccatttgacaatcctcctcctaggaattccaaattccaagtgagggctctgagaagacttcagataaggaaacccattgatttttcattttacctaatgtaacttgttttcctctcttggatattaataggaaatgcagctccacagagacagaaagccaggcagccaagccagtgtggggtctctgaaataacactgtgctagctgctactttccctgtctcatttgaagattcactctcccccgtctaagcacacccagaagaaattcatgaagcagatgctacgcctctgagtcactgcttttatttgcttctcctgtatccaccaccttcttagctttaattacatggtttggcacattcttaaggtaaggataaattcataacagagattttctcctcttaaagagcagctctggaggaagccttaagcattagatcaagaatccacttagatgtctatgcctcttctacatcttttcttctgcttactctaattgctatgcagtcctatctaacctctaaaagagtctgactttcttctccctcctgttgcattgcttgatataatggtataaacaactaagaagctgaaataatatgatgtgaactttcctaaaagccagtctgagaattctgcaataggagctactaagtaataaaaaagaactcagctggaaatatactttgaaaaaataaattggaagatggctttaaatgcttttgagtagtcccatggaatataaaaggaagcagaacacagaaaatgataaacaaaactttcaagactgactcaataagtagctcttaaaatagctatgagtttccctcctaacacccagcaggctgccaataaccagacagacaaatcgaacaattaaatgctatgaggcagcatcagaaaagatccataacaacattctgagcagagccttaaccactgcctgaataaaatggtcccaggcacaagaggttgtttctgacctggacaaaacagtgaaaaggctgtgaaatgtattcttttactgagcatctgtgatgtgactgataatctaatgtgttctgggaatgttgagataagagacacagactttttcaaaatgtagggaaggaaacagatgagtaaaatagtcaataaaatatggtccagtaaggttatgatatatatatgtcatatgtcattgggagattgggggaaaaacacttcactcagatgtggggtgtttgaagggctgagtcctcagatgagactttctaggtgaggataaattttccaggttaaaaaaagatcagcaaatagagattctaggaggacgtggtgtgttcaagggcatcaagccatgaaagggctggtgctttgggagataccgcaggccagtctggctggagtgctgaaaacatgtgaggacagattgtgaaatgactctggagcttgaaaagaggtaaaatcatgaaaggccttttgtgtcacgctaagggacttggatttcatcctgagagtgaagaagaaaccactgacacgatttatagtcaggtctcactctttttctttttcctcttatggccttcagcgggcgctaacactggttggcagaatggccaattcataatttatagatcaaagtatgtacttctcacaaaatgaattcaaaagtgattaactttttcaatatactgtgttatcacatcctgacttaatttgtttttctcctggtttaaagtatgtttctggatgtacaaagtaaatctttgcattttacaaagatttttttttaaagccaatataaggagacttcgtggtctattatatatgataataagttccaattggaaagaatctggtagtgttaataaagaatccttaaaaccaaagaagggaccatgtttaatgggaacatttataatgcacatatcccagtagcaattagaatgggggagggagaatcagcaacagatccatgagaatttggcatatgtggcctctagctttacataggctgatagattttcagtcaagcttgaatatggaagtcttgaaaactctttcctccatcctctgtttcctagagattactctttcaagtgatctcatcattgtcagcctctctgataagatcctagaccctggctgcagtttgactccagagtactctttcctttatattatctccacagacctggctcttttgcagaaagaaatttttaaatttgggacactgaaaagagcacatcaaatactgaaaactgtttcatgaggatcaaaagcttgctctctttatgcagctacttttggtaaatactgcttaaatagttactaggaagtcttcaactgtattactaaatgatattgcagtgaacatcaaaaatgggaggatagttcatttaatctgaaaagctgcatatttttatattatgtatactgcagtgcttgacatagctcactgtttttcatttccttgcaactgctggcctcttaaattgccttttttttttttttttatcatgtttctgttacattcaggctctttcttgctgagttattttgaaaaaaaaaagaaaaaacagttttgatctcaaaggtactgatattaagatttatccatacaattaaaaaattttaaatgtaggcctagaaagacattagaattgttccagactttttatagcatcaaatttcctcaagtctctaccattgcttaaatttgtcacccagctaatgtgtatgaggtcagtaaaatggaagtactggcatttctatttgatgaaaagttctatttaattaattatatttgtccccatgaagcctaataatgcatcaagattgaaaaaaattatatgtatacaaatatataaagaagataaatttataatatttattttgggttagaacacaatgttgccccatataaataacattttgatgtgttaagaaagaaagaaaacaacagttaaataaaccaccagttagattgagtgggaaagtgtttccttcctatacctacctatgcatttaatattttggcttaaatttgcaatttatgaatgcaattttagagaaggaaaaaacttcatttatactgagtatggtaagaatgttgtggggaaaattctagttattgtgaccttgaggggttaggctattgtaatatgccacatattacatatgccactctgtgtacagtgtagcagtagaattccagcttttgaatgaacatggtttcaaatgattggtccatattggggccatcatttcaatcaggaattaccagctctgtatattccaaaggttatgagggggcctgtaacatggcacattttcattttttcttctgattcttattctttcagaagtagctaccttttgaccattatcaatttttaaaaattgtactttgcacgtttaatccatttttaaccatacaataattacactcgtgtggtggtaaaattatgtgtcgttggggaatgcatataaaaacttgatgttaaacataccatagattcactcaattttttgatgggaaattttctgagcaaaagctgtctaaaaatggttctgatatatcccaaagaggttatgaattgcatcatttacctaattaatttattcactcttgctcattcattctgtaagtgagcattatgtgaacaaagaggcactactagggcacaagtacaacaaatacgagagatggagccacgagcatatgcttcaggcattgtggccgaggacaggcttcaaaagacactcctactacagtcggaaaaatctgagatcaattataagtaacatgcattgtattttagaacttttctgatatttcaaaagagaaaagaaattttccaacggcctaaacacacaataattagctaaaacttaaaataataatataatatcgaacaatttggaaattccagcttactgtggtgcatttattgctatcagtgctgagactgggaagctaacttgggaacttcattgaaaatattggaaatgaaactgagactcttacatttgattcagatctacaaaggctaggatagtttcatgtcagtaacaacctctggctccaagcataagtaataaaaaaatcctaactggaggaaatcttattcttttttgcctctcaggggtcatacagattaaactcaatcaaatgtgagttcacattaaaactcaaagcaataaatgtaatatgtaaaccaccatgagtgagtgtttgcagaaataagaaacgtatttagactctcaaggacttaagaaattaaaattattatatacagaatataaaataatatatgaaaagatcaaagaaataaaagctaaaacacaaaaatgagcatggaataaaaaattattttaaataattaaacagatttggaaaagacctaaatggaactctcagaaaccatcatcactgaaactaaaaattctatgagttactgcactcccatttcatcagctaaaataaaaaataaaaataataccaaacgttttgcaaggattaagagaccctggatttcttagacatttctggtgggaatttaaaatgatacagctactctggaaaaaagtcttcatcttcttgtaaaattaaatatgcaattactatttgaaacccagcaatcacattcttggacatttattccagagaaatgaacttttattcacacaaaaacctgcctcctaacatttatagcatttttttttactggaaacaacccaaatatcctccagtgggtgaatggttaacaggttccaatgcattcacacaatggaatactactcagcaataaaaaggaacaaacttttgctataagcaataacctggatggattgtaagagctttacacttagtgaaaaagtcaaatttcaaaatattacaaattgtataatttcatttatgtaacactcttgaaataacaataatataaaaacctgtagatatggagaacaaattaatagttgccaggggggcagagataggggtaggatttgaatataggtagagttctttcctatgatgacactgttctgcatcctgattgcagtggtagtaacatgaatgaagttaggctgaaactgcatagcaccacagacacacacacacgcacacacatacacacacgagagagagagagaaatggactcaggtaaaaatggtgaacagtgaataatgtcagttatctatttaacagtgtgcaaatgtcaatttcctagagcgaaactagtgaaaatttcatgggactctgagtacttttgttgcaacttcccatggatctaaaactacatcaaaactagaaaaaaaaaaaaaaaaagcttaaagctaaaattaaaaaacaacaacaacacaccgaagtatcaagaccatagttagacagccaatgctcaggtaggataaaagcaaaaaaaaaaaaaaaaaaaaaaagttttaaactgaaagagtgaaagatagatttgaaggaaatagccaaaaataaagatatataatatatatatataaatatataatatagaaatatataatatgaaagtggtgctaagagacacgaatgatagaataaaaaggtctaacatagacctaattgatgaatggaggagaggcgaaattttaaaaaatagtaatttatagtaccaaaaaatgatgaatgatatgaatccacagataggagtattaaaaggatgcccatgatgtagacatgttatagaaaaagtagaacaccaaaggaaagacagaaagggaaaatactaaaagcattcagagaaaagagagatcacataaaaagccaaatcatttagaccaagggttgctaaagagggctgcacatcataatttccatgaggttcttttgactatcaaatgccatactcaccccggtgaaatcatggtctttgggagtaggcctagacataagaacttttaatactcaccatgtgattccaggggttgagaaccattaatttagcttgtgagtaagcttttctagtaaataggcaagactaccagtggaatactatcttcaaagttctcagagaggccgagcatggtggctcatgcctgtaatcccaacactttgggataccgaggcaggcagatcacctgaggtcaggagtttgaaaccagccaggccaacatgatgaaacctgaaaccccatctctactaaacatagaaaaattagccgggcatggtggtgggtgcctgtaatcccagctacttgggaggctgaagcacaggaatctcttgaacccaggaggtggaggtggcagtgagccgagattgtgccactgcactccaggtcggacgacagaacaaggctctgtctcaaaaaaaaaaaaaaaaaaagttctcagagaaaaaaaaaaatcaatccagaattatataccaagcaaaatgagattgatataaagacattttctggtagataaaagcagagattgtatcacaaaagacttccaccaaaggaatttctaaaggatatattccaaaaggagaaaaatgagattcccaggatgtttgatagttaaatgagaatggtgagtaaagaaattggcaagtgtgtaagcaaatataacaggcattatccttaagaataaatgatcacgacaacaataataatctctgtgtgaggtttagaaatgaatatatgctgaataatgtttcatgtaagtcagaggtggatcagtgttaaagtgttttaaagtactcaaatcatctggatttgaagttggttctctaattttaagggctcgtgttattagattggatcctcctggataagtcaggatactttccccatctcaagggtcgtacccttaatcacatcggcaaagtcctttttgcagtgtcacattttccaggtatctggatgtggatatatttgggagctattattctgcctaccacagggccacctgtcagaaagagagggtcaaattacagaacacaggataatgcaagtgttcccaggatctgtcttaaaggactccaaaatgggcaaggtcgttgtacattcaatatttgataaaatattgaatgttccatattttcatattcagataaatttcactttgtctgaatcagattagtggtagggcaggggctatgagatgatagtggaaatcacatttcagatcctgaatggcattataaggcactttagaagttgacatttattcccaagggcaatggggaacctcttacatatttttatgtatcaagaggaagactaaattaagagtggaatagtagggtcatctctctgcttgctgcttagagaatgcattgacagcataaatctagaggacggaattaagaaatacagtttgaagttttagagtagattaaatgaatgaaggaatcacctgaagaggcacagtggtgtggccgataaaacccaggaatcagaatacttggcttggattagtggctgttttgcagtggatgttgcttgataactgtttgaattctctgagctggtggttaactgttggcaacttgtcatcaactacagggggagtatttgtaccggaaaatctgcaaatgctctcccactcttcccccagagccagaagcctccgcaagctagtggtggtgtgatattgaaaaaaataaaaccctcaaatcctccatcctcgatacagggaagctagcatcagtgaggctcacttcataaggttgttttaaggttcaaaatgaaaataggtagtatgcatgaggaagcaaggtgatgagaagttgctgaattttgttttgatgcttttgccaagtattgttactagtagggttctataaacagaacctaagtcaaattacctgtttaacaattttcagtaggtcaaatgtgctctcattactagagtatgattcacttggattattacaaatagaaatgtaaatacctatgtaaaagaacatatattcctcatatgcaagtgtatacatatacgtccaggcatgcacacaacacacacacatacacacatacacagggagttaaggtgacatacaaatgtctttttatctttcaagtttatacccaaagacattggaaaagggagacagatgaagatgagaatgtcagtgtcattttcctgaactcattggaaaattaggttttagctctttggccaaaggtgtttgctgactccacgcctgacacagaccgaaacactaactgatctcaatttcaggcaatgctagaaaaccacagttctccccaacatgaacaaagcctaatcccatgtgcacagcaggatggttttaaaagatgccattttgttgttgttgttgttagcaagctgattctaaaagacaaagagaaaaaatagagtaccaaaatacccatgcagggtttcttcccctaaaggcagcagttgtatgggaagcattcctgcctctctggggaagagtgagcccggaagagggatcagggttctaattccatggttcagtgctagctaaggggacctcatacctctagaaggctcctagtaatagcgaaaagggaggatttatatgattgaagagaagaacaataacaacagtactgtggtactattaatttatttttaggaattacattacttttttacattactgtaggaatccatatacatgctagtagtaatacttcaactagatggaaacatgagaaatggggacattcacacaatggtggtaagagagtgaatggatcccaacttttgcaaaataaaaatagcaccgtgccgtaaaaccaaaaatgtgctttctcctttatttagtaatctcagttataggagcttaatttatatttaaagagcaaataaacactaaaggaagacatgatacttgcacatttgtataactggggtggagggagcacatgggctacaaaatgtagaaaaatcttatacatcaagcataattttggccttgaacagtaatgccattgtttagctctgaatttcttttataccttgagtcccgctatagaatttttgctattgttctttcatctgtaggtcccttctctacaaggaataatcaggattccaggaactactcatatactcaaaatttttgaaatgagttttatgtcttggccacatctccttgatatccttcagcaagaaatatgtggttataaaatcaaatgggaaaaaacgactgcaatggtggaaaaggttttattgtcagatacactaaaacactttggatatgaatgttatgtttaattgatataaaagtctaaacacttacccactgtgctgtgattatggccagggtcattcttcagagctaattcatttagaatatgttaagaaaaatcctgtaagcatcagtaattgaggaaaattgaactcttgaacttttgccagatatttggctgtatgcattttatgtgttaactgagaagaagctgacaacttgctacattctgaaatcgtctcagttgagatttgggttgcaggagacattagccattagcccaactgcagggctattcactgtggccgtatcataccagtgctcaggagacagcagtcacacctaagaagtatgtccttcctcacctggactgctctcatagcaaagccacctgaacatccctcgttgttttaccaaccagattcatcatctgcttcctgattcggcaacgagcatcacctgttacctgagggagtccatccttgtaagaataagaaacttgactaagcaaagttagcatgtggttgcgtcttcaaagagcacaaacgatcttgtgaaggcgattgtttggataccaagaaagataaagatctctttctatctttagtgatagcacccataggtgaatagaaggaaggaggctccgtcttagccgggaggaaactcacttgttcaacatcactggaacttctaagttgaagtggaaaagggagcatgtgattttcaacacttccaacacttccaagagtagcatgtttccatagtcatgcataatctcagtctgatttgaggctaagaaaatattaaaagtttccaactcttaaaaagtataggagtcccacggcctggacacatagtaaaacacttaataaacactttagatttttttttccaaggaagcagattacgtcttgaaacaccctttactctcaggccagtatggtacggtcagtaagaggtatcaagtaaaattaattattgaagaaaattcttcattctagagtctaaataatttctcctgagataatctttttccacagttattttattataatgggattaccctaatagtctttgctaaaagagctgagatacataaaattattttttcatagtatagagttctaaatctttatgtccttattttatttattaatattattattaatattattatttttggaaagagagtctcactgtgttttccaggctggagtgcagtggcataatctcggctcactgcaacctctgcctcccagattcaagctattctcctgcctcagcccaccgagtagctgggactacaggtatgcaccaccatgcctcgctaattgttttgcatttttagtagagatggggtctcaccatgttgaccaggctggtctcgaactcctgacctcatgcgatccacccactcggcctaccaaagtgctgggattacaggtgtgagccaccgcacccagccaccttttttattttctttaaaaatcaaaacagaacatatttgacttaggcctttatcagacagagagaaggatgcacatacctaagctggtaaataattatgtcatcctcatttacagtataggaactttctccgtaattattgtactttgaggattaattttccatatctcatgtgtgttccttaagatttccacctcataccttttttttttttcagctaaagcataaatgtattgactcaatctcagtttaagaagtagggtcaacagagccttaggaccatctcctggtggctaaccatgaattgtttcctttcatgatttttttaagcacatgttgagttagatgccaagattctgaaaccagatggagctgactcaatgagcttccatttatgttccagcatgccagcattagctgggttccagcagatacttaagtaatgagatttgagcaacatcttccccaaagtattatcttctttagcctattgtagtttatgaaatttgggggattaaaatctggcttagagagagtaggtcacttcaattctcaaagccttcattttcttatctataaaatgaaaataacaaaacctacttcataaggtctagtaatgattacattagaacatctggtagaagaagccaggcaaagtgactacatgctgtgttatttcttttatgtgacattactgaaaagacaaaaccttaggaaaatattagatccatatttgccagtgattggtagtgggaacagcagactgactaaaaaggggcacaagggaaattcgaggagtgatatgctttttgtctatcttaattgttatggtagttacacaactatttacattgtcaaaactcatcacggacttttagtttatacaaattataactcagcaggcctgactttttaaatgaacactcatcacggacttttagtttatacaaattataactcaacagacctgactttttaaatgaacactcatcacggacttttagtttatacaaattataactcaacaggcctgactttttaaatgaacatatgtaatgggtttcacacacaatgcagactcaataaacaagccctgctcacaacttctctcaaaggagccaagcacaacaggtacttaaattaatgtcctttacattgaaaggtattatataaaaccaaagcaagcattttccatttttaacacatttctaaggcttttgcatttccataaagaaggcagtgatgactcatgatgtgattttaagaatctgaacttactaaggtcccttgaaagtaaccacaaaaaggctagatctaaaatatattaaaatccatatacaattaattgtagagtgattcatatagatacagtctctattttgtattgcttcttttttaaatagttatctgctagtgaacaaaaaaataaatatatactttttgatatttcaaatagatatcaaaaagtatatatttatagcttttgaagtataacttttaaactttatcaaatataaaagtatatattctatttgatatataggtatgtgtatgtatatatgtatatttatttgatatatatgtatttgaatagaaatagaaagtgaatactagtaacctgatggctaagaacgatcacatatttatatgtattcattcaacacatgcactgtgggttgtattctgtgccaggagatgaggatgcagggatgaataaatagtatttctgtcctcaagaagctcatactttatagtgatttagagacatgtatgatgaaattgacactctaatgtgagtctgaacaatttttaggcaagcaaatgctcttcatgcactacattccataaccaacctatgcacagcagtaagtggagtctttggggcttggtttttgttaccacgtttgttacagaatgccatatttggacctatgacaaaaaaaaaagtaatcttaagtcaggcttgcttattggagaataaaatagaatcatgaggtaggagatttggagggactctgttacagtcaaataattttattttaaggaaagcagatttactccttaacactatcttaaaatcaggagaaaatgtaagaaactttcataaaatatttaatatagtttcaaagttgtgagcgtatcactgttcagaagttaactgcaaaacagagatgactatatttgccataattatcaataatgatgtatatatatatatatactctatagttacactgggatgagcattaatggattggtaatgaatgaacaacagcaatgattcaacaacattagttggctaaagcttcacaagaataaggaaaacacagcaggaaccttatagaggtaagtgaagcatgaaattcagttacgtctttgacctaatagcattaggtcaaagcctttcaactttatctctttactaattatggaacgaaccctgtttaaactcttcataccatataattctctaagcaattcttagtggtagttattattattcacattttagcgatgagaaaattgaaatccagatagatcaagtgacttatctaagataacccaaccagtaagtggcagagatggaatttgacctcagccaatctgggtcctggtccccacccttgactctgtatgatacagtgttacaacaagagcatgggtagagatgcaattagaaggtaagaattatatctgcaaaatcttgattagtcctaacaataataatgtagtcactactgttaacccaacttgatgcaggctaatagctaaaggtcataaagtgtccaaagaaagatttagtagtaagtacaatatcccaggagaatctacctccagagtgcaagtcgttatactactcaagttgatatcttccaatgtaggtgtctaaaagccctttctagttctgaatttcactgattctaaaagggagtttgtggttagtatagctggtgggggtagacttacattgctgccaagtgcagaaatacactaaagccatgcacagcaactcaagggtcagcatttttgtcccacttctgggcatcctgaaaatcctttcttctttgagcttcctcaaaatcttgtataaactgggcttaaactaggtagatctcagctggagggaaagttctagcaggctgaggaagcctagaaagtttgcattctctaagcaatgttagcatgaactctttgtactcattacttcttagtatatggcagcagcttcagaaaggtgagtcaggaaacattcacattcccaacaattagaatgtcaccactctttgttcattcttttgaattatagtcaagaagtgtcttattaattcaacacaatgcataaatatatcttgagtatctccaatgaatcatgtactgttcaagcctctggcaatacaaacaataaaagacactcctacgtctcaaggaactatcactttgggtgacagagagagacatctaaacaaatatacttacaatgttggtaatacattcatggaggcacatgggaaggacccagaagcagaggaggttcactgtgcttggatgcagatagcaggagttaatatggaagaagtcaagaatgtcttcccagagatggtgaaaaacaaaatgagttttgaagatatgatgggaaaatacactgatttttagatatagctctagataaaaataaagagacaaagtgttacaggtaaaattagctgcagatacatcttagttgtcatgtagttgatccaattgagtgaacaattgaacaacaattagaacacaaacaaacctccatgatctgaggcctgctgaactctcttttctgacagcccttcccactgcacattggatatagaatgatgccatggcattccatgcatccatgcctttgaacacactatctcctctgcttgaatgacctttgctgcttatgtagaaggaaaaaacagttacattcatacctaaggttccagagcttccaagaccttgtcaaagaaaatagactcctagcttttctctactgaatgcaatctccgttatcaggccataagctccttaggagctagcgctagatctgagtgaacactgccagtagtgtgatgaatttggcttttataggctcaaaagaaatattgttaaatgtacaacattttttgagccatttgttaaatttttggcagcttgaagtcatctatggtgggagctgacaaacactacattaaaaaaagatcaaaaaatttgttggataaattacattagagtaatttttaaagtcacatattcaagttgtagtgatttaaattaaataaagttagtgcagattataagaattgatgagtattgaattgatgagtattggaaaaggggatgagtggagacacctctctgagcagtgtgagttttgaaaaggaaatcaaattattagagaagataatggtagccaaaaagactttctaaggatcagtgttctcataattaaaaaaaagaaggcataagaatttctgccaaacatactttttcaaaaataaaaaagatatatgaaaatgttttataaaccatgtagtacataactatataatatatacattatatagtgtatagttgcaattattggactaaaagcagttaatacaggctttacatatgttaagacttttattcagaagtaaatgaaatgtactctttgagaatgggtatattttattgttttttataaccatattctcatttatttttgaaactcttcttagaataagaaaagagtacaggaagaccaacaagtcacattcaaaccttataattctgcagcctaggaaacactgtcttgtgctggaaatggcttcctttcttcctggtccaacttttttgaactgcccatggattttgcactgtacaaatcacaatccttagaaatatattacccacatacatttctgaagagggttttcagggcccttttttgagtattacttttggatatattattcctactaaattatatttcttccagaaaaagttttgaaaagttggcaacctccctatttcagtccttcatattatgccacttgttacagtcataaacagcaaggaaagaaggaagtttgaccaaatgcaaatggctgggaagaagtagccctttcagagttgctgaatgtctcgtgtgaaaatgctttgtggctgagcttaagaaataaatataaagtagtatttaaatcctcatctcaaagcttctatcagtaatagatatgaagcccaaagcagtaaatgtttaaatgactactttacatctcttaaatgcagtgttatgtcctggctatatggtaatgacatcattaaacagaaatcctttgagccgcagaaccaagatgctttatagtaagttctatgaagttacatagtcaaagagttcactgttctttaagttagactcatatccgcaattttatgacaggttctgcttaaataattgtagggtagtggtaaagcatggactttagggtcaataatctgaagatctaaatttgaatttgtcgtgtctttcattagttagctgacattctggatttcagtttcaagacctttaaaatgggaataatagcaatcatcttaaacatgtccaagaaagagtgagacaattaaataaatacattactaagaagggctataaatgaaatgttattataggtattagcatcatcattatcattcattaccctaatcattatcatctttaagcaatattaagggatgacacttacagatagactgagtcttactctctgggtcaagaaggttatttcaaaatgcaagttactaaagtatattatatatgcaaaacatttggcttattaaaactcaagtgtcatggctcatagccgagacctgcactttcatataaatgtgatttgatcatatgtatcatattcaaaaatatctattagtcctataacgttagccacagtggctaatttctataatagcttcacattttagttacttaccaacataaatatttatttcttatttatgttacagtaaacttaagtttgcttgggtggaaggttgtctctttttcacgcaattatttagagttccaggcttcatccatctaatggctttgttaaagtctagagtcttggagtgtaccactgactccgttaatctgaccggcagataaaatagtaaagaaatcatggaagcttgcaaggaaagtacatgaaccaggcctggaagtggtatataccacttccatgaaaaatcctactggtttaaaatcggtcgcatgactgcacctaattgcaaaggaagccagaaaatgtagtccacctatatgctctgatggaagataaaatggatttgatgagtcttgccagcctctgccatagggttctagcatattacaataaattatgaatttaattgaccgaaagacaaagcgcaacttaatggtgtcacaatcccatgttagttataaaaaataatgtataatctattctcccctttatggttactgtaaaaattagtagcaccctagttaattcaatgccagaaagcagctgtcttgagagttcatggtcttaagctttacatgcctgggctctatttttggtccagtggagttggtacctctggggcctgagtaatcccgtgttgcagcagacagagttcctctgctgcagtcaggccttctcatcagtgtatacccctgtgaaacttccagactacacagaataacctggctttctctcctggatgtggatgtggacactaaatgctcttcatctgaacgaagaggtttgtgtttcataaagattaagctaactatgaggaaaaaacaggcaaccagactcttctgagattttctgtctgcatatagacatcaatataaacataggtatatgtttgttcagtatggcttttattattaacagaacaagagccagctccctgagagctacccaaggtcctaaaccacctctgatcaaagttatctcatatctagggtagcagaggactcctgatttttcagaggacctattcccgtcatatcttataaaatgtaatgattgacttcttacatacaagctgctaattttgatatggtctaagctgatatcagtttacgctgaggactttttcatatcccaacataacttgacctttcatcccatttgattgcatggtctgttcatgaccagccctgacctgtgataaccctcctttataatattctggtgttaaggatgcccaaccttgcgctaaagtaacctgatagacccagaaatgctgccagtacagctattttatcaggtgggatttagatatttatgcttctgtgatcatgtttatcaaaaattccaaaaacattttctcatgaggataacataagaaaggagggaaggggctgagcacggtggctcacgcctgtcatcccagcactttgggaggccaaggcgggcggatcacgaggtcaggagatcgagaccatcctggctaacatggtgaaaccccatctctactaaaaatacaaaaaataagccgggtgtggtggtggtcgcctgtagtcccagctactcgggaggctgaggcaggagaatggtgtgaacccgggaggcgtagcttgcagtgagccgagattgcaccactgcactccagcctgggtgacaaagcgagactgcgtctcaaaaaagaaaggagggaaaggagggaaggaaaagagggatgattgattttccctgccttactcacaggatcaaatatgataatgcagacaaaactgttgtgatgatatagagtatttttgtcatctaactcatctaactccatcaaataataggatagcttggttttgagaaaacaagtgacaaattatcatacttatttttctcatgaaatatccttcatgtgtgatctttatattctttggaaaatctaaaagacttacagttagtcaaagtaagcaccaacctaagttccaatctaatttcagaagtctgaatcattattttaattctttagggtactggaaggaatttaggttcaagatagctgtgaacaatgtgtttatatagtaaaacaagatttatttatttgttatcactaaattccatttaaattttacaatagctattattacaataacacactattaaattacaactgcatttatgtagatacaacattcctcaaaaatgttgtttggtatttaaagggcattattatgattatcagaaagaaattttgttaaattgcatttaagatatcttaaatgtttatctagttgattggttgatttattgacatgagtagaatattttaaattagtaggctacctagttaaattaatgaatttttatctttagtatcatgaatgaaaatgttgcacatgttgagaatgaatatgagacagtctttaagtcaagagcattacaatctgattgggaagattattctattgaatatcatttgtcagttactgtgaatagaatggtgaatgagacatttaatttgcatgtacttgtcatatctttcctactaggatataagcttcaagtttcagaagatgagaaatgtgtttaacatctccctctctctctttttgtacagctcttgattgtcacaaagtccgatgtgcttgtagttagcaaaaatagttggataagataaataaatgaatgaataaatacacaataacattttgtagagaggatgtaatagatcctaggaacttccatttaacctgtgaaatctctccacacatacagttcagaggcaaaatgttctggttttctaaatcctcgtgatcacatcactgttgtcagtttgccttaaagaaaaagttggaaaagctcatagaggctagttgcttttagctgtgaatctccaaatacttgaacatttcagaatgaagccaaacactgtttaaaatatcagcaagtggttatccatggatggtgggattcacggcttaatgtttgtttatgttttcatttatttattattcttttgcagaggggcacagatagatccattatttgtgacacatggtacaggcatttgaaaagattcattgatagcaacatcacagcaagtaatacagaagtccatattgtttttccatcaagagttatgctgaaactagcagagcttatgctatgaaaagccccctggtagagaacctcttcaccctaacagcctacatatgtgggaaagggaagcagggcatatctagatgagtatataattgggggagcatcttgagaaagacaatgatctttttcaaaagggccaagcctcgtgatctcagcctctggtatctgcctgttcttccaatgagttctctcaggtctgcagagctagctgcttgctcatttattgaaaaggactggaaggagcgtccagggccatctgcatttgtctctcctcacatgcatcttctaaattttccacaatcatcatgttcgtaataaaaacatataaggtgttttttgtttttacaaggtaaattaaattgtgtatgatattttttattctttaaatgtcgtacacaaatgcatcatcgcactttagccttaattggccaaccctgggtattatcctgactaacaatggaagaaattaaagaatcatgagtcttcaaagtcagcttttgaagccagcctcaacctacttaattacagttgtgcgtgtgtgtgcatgtacgttgcatattttttaatggaatcttcatactagtcatgagaatggatagtcttctatttttcttttaattttgcgtataaggagagatggagattatgatagaataaacaagttgctgaatgaaggacacacagttaagaagtgacttagtcttacctccagtgaaacctgtggaatatatatatatatatatggaatatatatacacatatatgtatactgaactttgcaacaatttacttgatttacatttggctcttttacaaaaagtcagagtgagaaagagaaaattccatagaattagaatattctaattctaatttatacaaactatcatgggtttatagcatctgaaggcacccatttgagtaggggggtgttacattgactaatattgacctatttctgagaagacatgaaagttaaagggtcaattgagtgttgttgttttcaagaccagtttagctcctcttttcattttatagtcacatttaggaattcatagcattcaaagccatgataaacagattatgcaaaagtaagtaagtggatagtgactatagttgcattttatgttaactgcatccttaaaataaacattagcatatcacagcttttctagagaataatttcagtgatttcaaattagcttgtttcagtaatttcacataatgcaacccacagagtgcagtgaaaagaacagagtgaggaccaccagacctcagcttaaaaacactcctcagctttttgttacaaaaagaggcaggtagtgtaattcttccttgtaatttctaccattcagtgcctatgtaataataaaatgagaaagaattgatagaatatgctaatccaaaaacataaaccattatctttataaggaaaattaaaatacagattagaaacaaaaaatatctctgaacaaagtcattaaaattaaaaactaatttaacaagggtttaaagatatgtaatgatatagtataaaagctaaattaaagtatctaaaagtaaacaagtgttgaaaagatctgtaactcacttattggaaatataaaactgcatcaaagcgaaaatagtgtaaatagctaatagaaaaaggaaaggtgcttaaagaaatgtaacctagaaacaaatgataaataaaatgacagcaaatatgcatcagaattaaaatacaaacaaaaatagttgaaattcgaaggtaactattttctgtactttccatctcttaacacattttcaccctctgtagggtcaaagacagaacagatataagaagagtgcgttaaaacaatttacctgttctcatagagacaggaaacagttattaaataactaaacatataaacataaaatatttgcattttatacttgttttatgtaacttaaactgtttcccatctgcctggcatggtggcgcacatctgtaattccagcactttgacaggccaagaagggcagatcatttgagcccaggagtttgagaccagcctggacaacatgacgaaaacccatctctaaaaatgcaaaaattagccgggtgaggtggcgcacacctgtgatcccagctacttggagggctgaggtgggaggattgcttgagcccaggaggtctaggctgcagtgagctgtgtttgcgtcactgcactccagtctgggtgacagaataagacgctctctctctctcctccctccccctatatatattccccatcctacctcttgctctagtcactgctgtagtgatcagtttttcccctagacagagcctccttttgtgctctgtaaatcctccaatgacccatttctgcctcctgccttggggtttctgtaaggctgtggcaagtaatgccagaaaaacctgacctgcgcatgtacaaccaaaaccagaagcacaagggagttaatgcctgtgaggctatccttgagcagtgggggttgggacctgatgtgaaaaatctgaaatatagtatatgcaggttcacagaagtcccattgggatcaagaacctcctgtagtgtcgactaacctgatcaaataacactattttggctttcttcccattcatttttgactccctcagctatcactcactttatagataaagttcagagttcaaacaagttatgtaacttactcaaggtcaccctatttgtaagaaacaacagcatctgtcctcaatgccttcctttagaactgaaggcacttaaaaatattttctacttttacctctttaaaaagaggtaggtttaaaaacctgccttctgttctttctccccattcagtgacttcaaggtatgcatgcccctgtctgatgtgaagatgtcactggcgactgcctattacataaaaccttctcaaatatgttcctataaaaaatattattccagagagcacatggttgatccaaacgggctaatctctaatgctggaattctaggtttctttgttcctgaaattggtcaagtcttttccccccaatatccataaccataatatgcagtttgtcactcagggaactccacacaggcacctatcacagtttcctggtaataaaaattaagaatatagttgctcccatcttgggttggtttcaagtacatcaatagaacaacttatagaactgtcatattttagagaaaattgcagaaagcagtgtttccagtcatttgctaactgagctagaaattataatggcatgccaaattagactgagctgtaaaaggaagatattcacattactcttctctgccctcacagtatgcataagacactgagaggcctgcaattcttattctcttaactaaacgtttttcaagtcttccccattctgggtgttgtattttgctccatttattttgccttgcatccagtcaccttgcagctgtaataacttgttggctctctagggaaagtggggttggagtcctttctggtcaccggatggttgaaggatgtgcacggctgaactgtttacccacacctcatccctcctcctgttctatttttgagaactgtgtgtttcataattttaataaaaatagagatcacactgtttatttggcagaggcgatgagaatagggcatgctttgctggattttttttttttcttgaaattttccttctcacactgctgcccggtctaaggtgagaagtggctgtttctatgtcttactgtcttaggtgtccctctgcctgctgtcacataagctgtttctggcagctctgcctgtgaccaattctgctgtctcctgctgggaggctgacacctaactggaccctttgttttccagagtggaaagaacctggtttatgcaggcaagaagatagtatcctgagaatgaaaagttagatactgtctttgagccatgtgaagtgcaaaaagacacaaacagtgaacagctcgttaaattaggaaatctaaaacacaggcctcaaatgagaagcatttgtgtccccaaatctcaactcctatgctcaggagtttcactgaagatttactgtagaggcaatgtagaggggccctgggagtttaacaatgaatataatgtagccccaccctggaaacagacagtctaagggggagctgaagactttgtacaatagattttaaattcagaatttattgtattttattaattagttttggggtctagttattccacgttaacctgtaaaagttgccttgaactataaagaggttaaataaacaactaagaggagtaacataaaatctgtattctggcagcaatggaaatgtggaagaaggtaatcacattttcttttcctgacctccagaccaagaagtaagatttaaaaatggcttgtttcagcacacacagccccgttttcattttcacctatctctggccttcttatgccaatacctcgtgcccagatactcctatttggagaacaagagcagcagcttaatcagataaaagtaatatttttcttcttctttctagcaaaacttagattctcatagagcagagtctctcagctgtgtattagggaagaaatcaactgattaagctaaattattctatagtgtgaatgactgatagaatttttgttctagaaacattagtgttttaaatataagccttcctttaactatttaccttaatgatttgtgtttggtgcaacttacttctttagaaggacacatattctcaaggactcctaaaaacacatctttgcaccctccagggtaggagaataatggatggagaaacattgctctgcctcagtgattttcgagaagcgagagaaaggtgtctgcccagatggtgaggcattttgaaatggagccatggtgtattttgaaaagaattacagcaatactgaagtgtaacatcgtgtgtagaaaatgaagcacagatatccacaattctacgatccagattctctaaagtaaaattttactttaaaaagtcattgtgaatatgtaaaaaatacagaaattatcaggtagaaaaatgtctcattaggagctcatccagaacctccaggtgttttaatcgtattaaaagtaatataaaccagtattgagcactgatctggttactggtaatttagttcatatcaaagtgaagtaaagcaaataagcaaaacaaccaaagcagtgtggtgttctggtcaaaaaagccacctgggccagcgctggctgggcctctggaaaattgggaatccatgggctctccatcattgtatagctgctgccctcaaccattctaatcacacaattggaacaatcccgacccctcccctggtgtccacggtgcttattccgcagcatattgagcctctctgtgccagacacggttttaggaactggggatacatcctcctctctctcatggggttcacatttgaaccacaggagacagacaaaaaggagtgtcagatgctgatacgcattgggaagaaaacttaagaaacagtgatgtcatagaaaatgactggggtagggtaggggattattttatttggctggtggttggagaactctgaagaggtaacatctgagcccaggttaaatgacaagtttccagccttgcaaatatcagaagaaagagcattcctggcagagagaacatcaagtgcaaaaccatgggggcaggaatgagtttagcctgttttagaaacggagagaaagccagtgtgaaccttggagtgtgaccctggagagacaggcaaaacgtggaagccatagagcttcctaatccctggttgggaaactcattttacttccaaatgcattggaaagccctggagaattttgagcagggaggtaagaacagtttatcatttttaagtataccttttataataagttaaatgctaataaaccaatgactgcttgaatattatttggattccttgagagaacacatggctaaagaacagacctgtcttgctgctctctaaagcaatgaagctgatggaaaactcagctttgctgttcagcacaccgtcaccatgccaccctttacgtgccttgagccaatgtgtgtatgtgcctctaagacttctgagaccaaaacctctctttctgcctacttagcatgcacaccacaattcctctgaagtgtctgggggctacccgctttgctgtgatcttcttttagtgtattttaatggattttagaagagtgttaaatctctgctttgtaaagccttattcctatcctcaaattatctaaattcattaccttcttgctataatagtttaattgagtataggatacaaagctaatttatttcacatttttgcttttaatagttttcacttttcttattgaaaaagtaattactgaattccaatacaataactggaaatgacttttctaataacacatattatcatgtcatcatcagaagaaaattctttgaagtaccctcaaggtagaaagccctccatatgtgttttctatgttcatatatacatatatgagtgcattttaatgatgtgctgatattctattattttgcatgtactataattaaattgaactatataaaaaatgactttttagatcatagataatcaaatacttgtttatggttcaatctaatgtaacaattttcctacattttaatattttgtttttaatttttaatatcgagaaatgccatttatactcatcctatgtttatctaaatatatgtatataaattatacttgcacactagcctagtaatttctttagaataaattctcagtagttgaattattgcacatggaaaagaacatgtacatttttttttttttccttgagacggagtctcactctgtcaccaggctggagtgcagtggcacaatctcagctcactgcaacttctgcctcctgagttcaagtgattctcctgcctcagcctcccgagtagctgggactacaggcgcccaccaccacgcccggctaattttttttgtatttttagtagagacggggtttcaccatgttggccaggagaacatgtacatttctaatgcatatatttccaaatttatcttaaacttgtttatacaatagtattataagtagtaatactggatatgattgttttaattttggccgatcttttaggtagagaaaaaaagtttactttcgtgtgcatttccttgacttaccaattaaagcacttgagcattttttataatatttttccaccacacctgtcccttcaatcttttttaacggcatcctctcacatgctgccattaattcatgtactgtgtttagcaagcaaagcattttcaggtgggggtcattcctgaggataataaagtggatgaagtaggttccatgggatgatgatatcaactccaagggttaaaaaggttcaccattatatctttggaaaattagcttgcagtttgagatttgctaaaagccagcccacaagatgaacttcaccaggctcttgtctaaatgcccatcagagacattctggaaatactgtttactgggttaaggcgttaagacatctgggttaagcgccatcactgggatagtttttctgaaaaacccaaaaacatttatgatcttctatacaaaagcaaaaacttaacaaatacatgctctcttaccagagtaacaggggaatatattttatgcctgactagagctttgcaaggttaaatagggaagaaagataaagaaaaagaacaagaactatttcccgagcaatatgagaaaacgctggcatgttggagtttagtcccatgaactcattcacagatggggccctctgtccctctctcataatcaagaaagtgatcaggaatggagaataaatgattgattctagaactgtggaggagttcacttctcagaatgcggtttctgagccagtagcatggcgtcaagatacaccccaggcctgctaattcagaatctgcattttaacaagatccccagggattcacatgcaccttagagtgtgacaagccctgatttagaagatactatttgcagagcctgaagtacgtgaggtatggaaagagagacgacagaaaaagaaatcaccaagtttcagccttctgataaataaatacattgattaataatatggtacacaaagggatggagatgggaagttaaataatgacccaaggcagtgtgatatacaacacatgagtgtgcagtcccaattccttgtgacacagagcaccagagaagaataaattccagtgagtcggattagtttgtctttgatccattcagaaatgttaaattaatgttcttgacattatgaaataaaacaacacatctcaagtgcttacaatgatgtttagcacatggtgtgcagacaaccaactttagctagtgttatggctgttattattgtcagcatctttgtcctttgtcaagtaattggactactaaaggaaacagtacatattagagaagaatattgtgctaataagtgtgaggtatgattatataaggccaccttaattactgcaagaaaaggaagagaaaaagttgtcactttaaaaagctcagcaacagaatatcccgcatcagcacttagtggatatgcttgccattaaagccatggtgtggaattcctgattactcagcttttgcaaattgaaagaataataaatagcacaaaaaggaaaatggttacttcttctaagatgtatagaaacaaacatctaattttcatgttatgcttgtttaattaggtaatttactgtaacatatatttatcagacaagagtacagataagatgaggctctttttccctttatatcatattatgagtattaatttatactgcacaaaggacttactgattcttttcatgcgcgtccgtgtgaagaggccaccaaacaggctttgtgtgagcaacatggctgtgtatttcacctgggtgcaggcgggctgagtccgaaaagagagtccgcaaagggagataaaggtggggccgttttataggatttgggtaggtaaaggaaaattacagtcaaagggggtttgttctctggcgggcaggagtgggggttcgcaaggtgctcagtgggggtgctttttgagccaggatgagccaggaaaagaactttcacaaggtactgtcatcagttaaggcaaggaccggccatttatacttcttttgtggtggaatgtcatcagttaaggtggggcagggcgtattcacttcttttgtgattcttcagttacttcaggccatctgggcgaatacgtgcaggtcacaggggatgcgatggcttggcttgggctcagaggcctgacaattctcacataatgatgttggtgattgagatttacaggcaaaagacaaaagtgtgactatagaatataagaaaaaaaagaaggggagaaagtatatatttaagaagaatgaagtgtaacactaagagacataaaaccactattctggtataaaatatagtagccaattccatattctgggagtaaagaaataaattcaaatgttaggtcataccaaacagcaaagaaggcttgtacatgtgacctaccctttctgggacttaatttctccatttctgaatagagaagccaggatcaaatacagatcacctgagaaacagtggagaagctcaatattgccatgttttgtttcaggcataggctttggagtcaggtcaactttcatctgctttgcccactgaactagcgctgtagacttgatcaaattaacttatttgcatattaataaacaaatgaatgctggaatgagtagaggaaatagtgctttgattaatttctagaaatctgcctgtctcactcaggagctgctgggtgtggaaaatgaagagaggaagtaagcgtagtgttgagttttcccaatttgtcgctcttctgaagctctctttttcacttttcgcttgggctttcacgtaaaagttggtttgaaaataagttttctctggaaaaaaaaaatcttatgtaagaagtcttcaaccttcttaaacatgacagccatccacctttattggggagaggtaggtgactgtagattgctgaatagacactgtggcttgtgttaatgactcatgaacatagttaacagggaacaaaaaggacagtgagtatttaagtggaagaaaacatcagaaacttgctactccattccaatatacataggaggtgggcatatttaatggaaaatgcaaacacgtttagcattatgactatgatttagaatgttaggaaacaatttctctgataaaatgctatatatctgtatattctaaatagttgtatcactgaatcagccttcgcacttttcttctagcatttgatggcacccaaccacgtcttcaagttgttatgcctgttttcatttctttatgagacacgaatgttggcaaaagaaattgacaattttaaattgacatagcctgtttccttggaattttagaaaattttaacctgtattgcgaattgagatttatctttggcttatatgttttttatcatagcctatgaaataaaatctattattattaatattatgaataaataaacagaaaatctttaagatagtgcatcggtgtgggaatataacgcatggagcaccatttgaacttgatgaatattagcaagtaacacaaaggttcataatggctgataatgcaggtggtaaaatgactcattttatgttatacataaggcacccctctgaagtatacccactttggaaagatacacacaatcgaattagctaagaaacctccaaatatctttctaggatttttcatctctagaaaaagtcagatattcctaagagggaaataagtagaactattctacaaaaaatagttaacacagcaggcctgagtcggatatcttcaagcctgcttgcaaggttggcccttggctgccatctgggaacatgtattttgagatagtccccatttttctctgataagaatgcctcattgcacctaaactgtttacacaaacaatattgtttaggctgaatacctactttcctctaggtatctagaattttggtagtcaaagttgggtggcaggggtgcctatgtgaccagccaccaataaaacacctgagctctcagctctaatgagcttccctagtagacaatattgtattcatgtcagaaatatttctggaacaattaagtgtgtcatatgcgatcccactgggagaggattcttagaagcttgtacctattttctttggacttcattccatgtgacttctccccttgctgattttgcttttcatcctttcactgtaataactcatagccatgaacaggactatcaaacttgggcttggtcttgtggaccaccaaggcaactgtattattgtgtgtgtgtgtgtgtgtgtgtgtgtgtgtgtgtgtgtgtttctattaatatcgttgtttatttgatgctcatattttcccagttttatcagtagaagcccctccaaggcagttcccatatccttttgacagattcccttaatttttttatgttatttgattttttaaaattatactttaagttctgggatacatgtgcagaacgtgaagccttgtcacataggtacacacgtgccatggtggttcactgcacccatcaacctgtcatctacattaggtatttctcctaatgctatccctcctctagtcccccacccccagacaagccccagtgcgtgatgttcccctccctgtgtccatgtgttctcattgttcaactcccacttatgagtgaggacatgtggtgtttggttttctgttctcgtgttagtttgctgagaatgatggtttccagttacatccatgtctctgcaaaggacatgaactcatccttttttatggctgtttttaaaatgttcacctaaaaaacagatattaatcaattgcccactgtgtatcagacagtgttctggttactggggatacagcagtgtttaaaacagaaaattcctctgccaaaactagaagatgtcatagttagtcttaatagaatgctataatgtcctaaatattgtttaggctcaaagcgcctactttggccatcggcaaattagaattatatcagcaaattaacaagatatcccctaaaatacccttgatgcatgcggagacttcctctatccatttcttataccatgttgaccccctcattctccctccccttggtgccaatttattatgaccacactatgtaatgttgcatgaattgttttgtaattactctctagtgcttcaagtgggtatatttcatcttcccagtaagtagagagcaaatacaatacctcttttatgggttattttcatcctaaggttgctcagtctggtgtcctgcagacaaagtgtgctttcaaacatttgataattttttaatgtatccaatgctctgaaactattgctgcatttctgtctttgagcatgacttttttttacctgatagccacaacaagttcatattatgttttacttttggattttcccaaaagagctatgactagaggatagcatttccacctggggctttgtctgacttgtccatgactggtaattacagtttttgtctagatgtgacttttggtccagtctctgagcctccagcaaaccatacatcttcgataagccatgatgcttagagaactcattgtttcaatcacacagccatgaaagagaaccaccgacatttgtctcaaatgaaaatggagccaaaattcataggcaaagtcactctcccacagatttcacagaacttagagattcagagaaagcgagggtgttccgttccattgtttttgcttgtttatattttccattgatccaaaaataattttagcctgagaagacaagggagatcagtgagtggcagagacattttgggggtgacgttctggcaagggaattcagactttgagaagctcatcaaaatgatttgggaaagttttgtacccaaattaacaggcaaagtgtgtctttgtcaataataggataatctatttttctactaatcaatacttgagcaaaaattatgatttcaagtactaccttattgttccagcaattctatgccattggttgagaaatgagatgcatccattttagagttgctcctacagaacaatcagtgctttcctgggttatatttataaacgcattctcagttctgtgtcaaaaatacagttttacattattttttcattcgcgttattaaacattatttaacctcagaatgatgaaatggattaataatatgtcaaggaatgatagtgtaagctctcagtacattgcgtgaggcacatatcactattaataatctagaattgtatggcagtcattaatacttttgttttaatcctgtgatgctgtcagattattttgtataccattcgtcttttactttcagggtcatgacttgaaattttttaaacttattctttacggtatattcaggtatttaaaagttcagtagaaatgggatggaaccgttaaaatgtagagctttcctctcttggataaggagacctttttccagaattctaagtgaactgctatggcatgatgaagactagcactctcaggccaggtgcagtggctcacgcctgcaatcccagcactttgggaggctgaggtggagagtttgagaccaacctagccaacatggtgaaaccccacctctactaaaaattaaaaaaaaaaaaaattagcctggcatggtggcaggcatctgtaatcccagccatttgggaggctgaggcaggagaatcgcttgaacctgggaggtggaggtttcagtgagccgagattgtgccattgcactccagcctgggcaacaagagtgaaacgtcatctctggggaaaaaaaaaaaaaggctagtgctctcaatgtgctgagtcttttgtccctgacttaatctaagtatagtgcaccgttctcaattcataagcacagttgacccttgaacaacagagttttgaactatgtgggcccacctatacgcagattttttttcaataaatatatttttaaatgtttagagatttgtgacaatttgaaaaaactcactgatgaaccacatagcctagaaatatcaaaaaataggaagaagttaggtatgtcatgaatgcataaaatgtatgtagatactagtctattttatcatttactaattaccataaaatatacacgaatctattataacaagttaaaaattatcaaaactcatggacacacacttacagaccatgcatggaaccattaacagtagagagaaatgtaaacaaacaggaagatgtaatactaaatcataactgcatacaattaagtagtatgtaactgtactactatagtaattttgtagccacctccagttgctattatggtgagttcaagtgttcctactgtccacttaaaactctgtgtgatgctaatcacctcctcctgagcagtttgtctctccagtaaattgcctagtacagtaaaaagcgatctctcacgattctcacttaattttcactgtatttagtgcaatacagtaaagcttgaataacaccatgagacccatgcaaagtgccactagtgatgctggaagtgctcccaagaagcagagaaatgtcatgacattacaagaaagagttgaatttcttggtatggactgtagattgaggtctgcagatggagttgccaccatttcagacagacaattcattttgtaaacaatgtcaacttatggtatcaataaatacagtactgtactgtaagtctattttttcttccttatgattttaacattttcttttcccttgcttactttattgtaataatatagtatataatatatatataacatacaaaatatgtgttagtcaactgttgatgttactggtaaggcttttggtcaacagtatgctattaatatttaagtttttaggaagttaaaagttgtactcagatttttgactgtgcaggaagggctggttcccctaacttccatgttatttagctgtatagcattatatgcttactgtacatattttgtatacttaccccaataggagcattttgcatgttccttttaggaaagttgtgttgactcataaccataaatggctgtttcctatgtgcaagtgatagattctcttgtgactatttctaacatggcagttcaaccaatttgactttaggtccagtgttttggccagctaaaaacaatgcctgtttaaatgtgtaactgaaggaccagagtctctgtgaagtcaccttctaaaaattaaccccttctcttggctgaaaattgtaatggagacagaaataggtagaggcttaggtggtttgatcatagaactctacttgaagagctacatagctcaacagtctagatacataagaggataaaagagaatgagaaacaaaaagcaagtcaagattagttttctatgacctcaccatgcccacaagaataccaaactggcaacagaacccagagctttccctgttttaaagttaattttaactttcaagattaatgtaaatctaggtagccaagagtctccatcctatgtccagaggaaccaagaccagaaagctgtttcagagttgaatatctgatatttagtgatgaggttgtccttgcttgagtgctggaccttagttatccctaagtttcttgtgaggcgtgtgatgtattgacaagaacttaaagatttggtcatcagggtttctaggtctaaacatgagttctaccgtttactccctgggtgatcttgggcaaggtgctgaactactgtaagcctcaattctactttttaaatgacagtcagcattaccagataacgttggagcattaacaagaatatctgtgtcaaaaagtaaggaagtagtcaataaataagtaaataggtgaggataatagtatggcaaaggggcaccagaatttctcaacaaccaatgtttgaacaactagagcagcaaaataaataacacagttctagattataatctgaagtataaatatacatgaggccatactgatgtaaagaaatgacttcataaataaatacataaaataaaagtgtcaagtcatgcttacaaggaagattccaaacaacagcgtaggtagattctgtcccctccagtacccaggagatgcgatataattcctgtgttcctttcttaacattgactggggcatgcacttagtgactcgttgtcaaagaatatagtaagaaagggggagaaagggtatttttatcgtggagaaactaggtaaatactaccttaaccaaaccaataaggattaacatctccagcatgttatgtggatatcatgggctccttgtcattctgtgaacttcccctttgagatagtctcccataacctataattccagtctaatcataagaaaaacgacagacaaacataaattgacagtctacaaagtatctaaccagtattcctcaatctgtcaaggtcccgaaaccactgaaggccagccaagtctaagtaaacatgataagaaagtgccaggtggtatccaggatggagtcccaggatgggccaaggggtggggtggggagcattcatggaaaaattagtgaaatatgaggaacacctgaagtttaaagtaatgggtcagtgttggttcttagttttgataaatgtgtcatggtaatgtaaaatgttaacattaggaaaaatcagaaggtggtatactagaaatcactgtactatttttacatcttttctgtaaatctaaagtaatcatacaatttaaaagtttattagagaagaagaataagaattggacttgtaactaaggggtgtgttgcccagtaagtgacagaaaaaaaaatcaatttgtttattcttctttttcttacccatactgagaataagggctctcaggcactgaaggctgcacatcttatgattgcatctgcatgaaggtcaataataagcagagctaaagtgcagtgctggaagccaggagggcaggcacccttaaagggcatgacagtgacaggggtgggggcacgaggaggagaatgctaaggttatagacatgccctgtttcttgctctggattctggttacatagatgtggtcacctcgtcgaaattcatcttactggaaaattaatatttcttcacttttccatttttgtgttatacttaaatttacaaaaaaataaaaaagtttatattatggggctgggcatggttgctcacgcctgtaatcccagcactttgggaggccgaggagggtggatcacctgaggtcaggagtttgagaccagcctggtcaacatggtgaaaccccgtctctactagaaatacaaaaaatagccaggcatggtggtgcacacctacaatcccagctaatcgggaagctgggtcaagagaatcgcttgaacctgagaggcggaggttgcagtgagtcgagatcgtgccattgcactccagcctgggcaacaagagcgaaactccatctcaagagaaaaaaaattaaaaagtttatattaaagaataaatgtcagagataaatggagagtacagggttgcagttcatttgaggattgcattatctctccttcctaaagttcaatttgtgtctcaactgactgcatcaaaactaaccccaacgtcttttcaaggtcatctataacacacacaatgcatgctgctcttcaagtcctaagagaaaacagaattagtagggctgccttctcattcacaggatcataccttaactattcagaaattgacagttcattgtgatcaccaccaggtgtacagtatttagactaaacagacagtaaagatacaattccaaaagcttcatgataattccattttcatgaatccatgtatgttttctttcaagtttcaattgtgtttaaattttaggctgggaaaaaatagagaaaagacatttgcctttttctgagcaatttaattatggaaagggggtactcattttttagcacaatctggttttatctgaggttcgtctgtgatcagtggcaagcaactagtttttgtttttacacagggaaaaatatggaagcagtttttgactcaaaggccctactcactttgagttggatgtcccctgagaaatacctaagaagtagctttaaaataaattggaaagcgaagtaggaaaaaggtaggggaaggaagaggagtgaatgaagagtcagcaaatgagcaggtttccatttgaaatttaaattggcagctggcactatttgaatcattcttcatttaatataatttgaatggggtagatgataatcttgcattttgagaaggcaaagcaaaaccttgaatatgaggaatgtacaaacctctgttattttgcacagctcagtttaacacacttcccttcactatgcttagaagaaaatgaggtgtaggtactttagttgtttatttcttgtcagcacaatgcataaatgatgtaagcgcaagattcgaaccacatggtatgtggctatacacgattaaatggaattattgaaacaaggggcaaaaagaaaaccttgaacttgtgattgagtgaaagggaaacatccataatgttgaaattaaggtgggattaaaagatagtcattaataacaaagttatcatgctagtagaggttgatcagttaggaacgatatgaggaaaagaaaacttaattaactacagaaatatgtaaattactttttatacattccagataatgtgttttatttttctagaacactgattttgtatacttattttaatcagcattctgaatacaaacatctcaaaaatacaaacacttcacatacgaggaatgctaaaattagactagaaaacagccacagaacaaagagaatagcacaaaagagtcttacaaggaagacattctgacagacccatgaaaatagacacagtgtcctagactggatgtattatatcatctcacatattagagaaggggactgattgttattgttcttctagagagaatgtgcattttgccagcctgatcagattttatcctcatgatgtttagaggtacatattgcttctccggttttatacatgaaataattgaagcttgaaaaagtaactttaggctcaggtagttatagaaaccatcagaatttgaacccaggtcttatgtgatcctgaagctactgcccttggttaacattttgcagacatctccattttcctcagtgacaaccaaggaaatcatatgtattagaaaaatctcagggaaattttagatatatttagaagcatgaggaaaaaaatgggaattaaaaaaaaaaaaatcacatctttacgaaaggtacagaagaatgggccgggcacggtggctcacgcctgtaatcccagcactttgggaggccgaggagggcagatcacgaggtcaggagatcgagaccatcctgactaacacggtaaaaccccgtctctactaaaaatacaaaaaattagccgggtgtggtggagggcgcctgtagtcccagctactcgggaggctgaggcaggagaatggcgtgaacccaggaggcagagattgcggtgagccgagattgtgccactgcactccagcctgggtgacagaacgagactctgtatcaaaaaaaaaaaaaaaaagaaaaaaagaaagaaagaaaggtacagaagatagaagaaaataaaacaaatgatgaatgattctaggaggtgtaactgattctaaaggagttggaaactacaggcagtgacatccggaccccaactccccttcaagagcacctctggggtgtaaaggggaaaacagacttgggaattaacctacttggggtttggagtctggctctataaaactatttgtgtgactgcctgcaacctctttgtgtttctgtttgttaatttatgaagtaggaaggataacgtctgcatcattgaagtttattgtgaatattaagttagatgatacaaataaagaactgaatatacctagaatccattaagctctcggatgttagttccttcctcatttcataatatttctcttcagtagaatacagaaaagggcccacaagggatggatgttatttgctctgcctatgataagaaagaattttagagtcttgccaattattcggcctcatgtggatcaagcacatagatattaggtctattcttttccttttttttctgtccagatgcttggattcatgtacatgaaactgcttgttgcataaggaccaaagactgaaatattaataatggaattgcattttcatgtggactcaacttatcagttcccaaatttctaccttgctgtgcgaacagagaacatgtggaaacgtctctaggtgtctgcagttcactcagtttctctaattctaattattaatatggcattagacatagaagagttaagaagctcaagaatcagtctaggattacttgcttgtcatttaatgtgtcagcctggtaaagacaaatattttatgtaaattcaacaagaagtaaaagaatataaattatctagtggccaatagcttaaatacataacctgggaatataatcagccatgagattcaggaagggtgtttcacagttgtgcataatttataatgagagggcaggtataaatataggtaataagggatgaaggtatttatacttttaaaatatttaaatgtagtttgattacatccccaaataactttttctgccctgtcatctggtgtaactaaatatagcctggcattctggtagatcggagatgtatcttctctgtggataattagcctcttgtattaaaaataaaacctataaatatcacttcattagtaggattctatcctcttccctgctctctttatgatctggaataacccacagacatttagaagtctaatggccagaacgaaataaccgaggttggttttcggggctgttgagtgttgtgggtcaataatgaaaacggactgctcctaggttttagatcaacgagctctcaagggaaataaatgaaatgaagagaccatgggagtcaggaatttgctagttgcctcatttccactttttgtatattcttcttagttttccttgtacattaaatcattatgctctcaccaaggagagaatgataagtacctgattcataagatcttcttttctaagtaagttcctaattttttcaagggtaaataataataattcaattcttcagttcttctaagcatcatctatcatgagttcaaatatggtcacattaacataaatgttcaaactatgatagctcttaaccattgaggaacttaacttttcccctggatttttttcaggagtcactgaatgaaatgagatggctgtgtccccacccaaatctcaacttgaattttatctcccagaattcctacgtgttgtacgagggactcacggggaggtacttgaatcatggtggccggtctttcccatgctattctcatgatagtgaataagtctcagagatccgatggatttatcaggggtttccacctttgcttcttccttattttctcttgtcaccaccatgtaagaagtgcctttcacctaccaccatgattctgagacctccccagccatgtggaattgtaagttcagttaaagttagtcctctatttcttccccatcttgggtatgtctttatcagcagcatgaatacagactaatacagtaaactggtaacagtagagtggggcattgcttaaaagatacccaaaaatgtggaagcaactttggaacttgggtaagaggtagaggttggaccagattggagagctcagaagaagagagaaaaatgtgggaaattttggaacttcctagagacttgttgaatggctttgcccaaaatgctgatagtgatatggacaataaggtccaggctaaggtggtctcagatggagatgaggaatttgctgggaactggagcaaaagtgactcttgttatgttttagcaaagagactggtggtattttgcccctgccctagagatccatggaattttgaacttgagaaagatgatttagggcatctggctgaagaaatttctaagcagcaaaccattcaagaggtgacttgggtactgttaaaggcattcagtttataagggaagcacagcataaaagtttggaaattttgcagcctgattatgtggatagaaaagaaaaactcattttctggggagaaattcaagctggttgcagtaatttgcataagtagcaaggagcctaatgttaatccccaagaccatggggaaaatgtctccaggccatgtcagagatcttcacagcagcccttcccatcacaggcccggaggccctggaggaaaaagtggtcttatgggccgggtccagggtccccgcgctctgtgcagcctagggacttgttgctctgtgtcccacctgctccagccattgctgaaaggggccaatgtacagcttgggctgtaggggctgtggcttcagagggtggaagccccaagccttggcagcttccatgtggtgttgaggctgtgggggcacagaagtcaagaattgaggtttgggaacctctgcttagatttcagaagatgtatggaaatgcctggatgcccagataaaagtttattggaggggtagggcccttaaggagaacctctgctagggcagtgcagaagggaaatgtggggttggagaccccacacagagtccctactgggtcactgcctggtggagctgtgagaagaaagagggccaccatcctcccagaatggtagatccaccaacagcttgcactgtgcacctgaaaagccacagacactcaatgccagcctgggaaagcagccaggaggcaggcaaagccacaggggtggagctttccaagaccatgggaacccacctcttgcatcagcgtgacctggatgtgagacctggagtcaaatgagatcattttggagctttaaaatttgactgccctgctggatttcagacttgcacgggccctgtaacccctttattttggagaatttctcccatggaaacagctacatttacccaatacacataccccatcgtaactaggaattaacaagcttgcttttgattttataggctcataggcagaagggacttgccttgtctcagatgaaactttgcactctggacttttgggttaatgctgaaatgagttaagactttgcaggactgttgggaaggcatgattggttttgaaatgtggggacatgagatttggaggggccagggcggaatgatatagtttggctgcgtccccacccaaatctcaatttgaattgtatctcccagaattcccacatgttgtgggagggacccaggggcaggtaattgaatcatgggggctgatctttcccgtgctattctcataatagtgaataagtctcacgagatctgatgggtttatcaggggtttccactttggcttcttcattattttctcttgccgccatgaagtaagaagtgcctttcacctcctgccatgattctgaggcctctgcagccatgtggacctgtaagtccaattaaacctcattttcttcccagtctcagatatgtctttattggcagcattaaaacagactgatacacaaagaatgtacatttagtagttgcccttcatgaaaactcaagagcattgcttctcaagtgctaggcattctactaccttctcctttggacacacgagtgctcttcaggaagccgctcttgtgctgaaaggtcccagagcagtactgtgaactttggggcaatggaggaggtttgggcaacttctcctcttaactaagttgttcttggttacctgtcccctgcagcagatgcttggcccagacacatagaaaacctaatataaacaaacactttcagtacttaacgctagcccttctctcatatatcaactaggtctggctaagttatgctacccacaaatctcagtggcttaaaaccaaaaaaactttgttttgttttgttttgttttttctcccacaaagtgcctctcagggcttaacaaaggagctctgcttgtgggagacactcagagaccaaagtgagtggattagctctcacctcaaattctgctgcttcctatgccagagagaaaggaaactatttcaaggacaattaaatgcttgacctgaaagtgacacattgcactttcacttacaacttattggccataattatcatatgaccccacttaggggcagggaaggtccaggaagtacaattctatcatgtaccctcatggaggggaaactggagacttttggtggacacaacaatctctttgtgaaagggctcaaaacctggctgagtgagaaccattaaaagcctatcttttttattctccatgatttccaatcccctcccacctatgcccaggcacttctatgcagaccattcctcaggaaataaacaaaattatccatctcagggaattaattgatgcaaacagataccttcagagtttctttacttttcaaattcactagcaatctaatttggactcagctaagataccttacaataacatatttttatttttgaatgatgtcgacattacaagctattttacaggctgatttgattctcatgaaaatgtttgcaactgaagctagccatgtattattttccccatttgatattataaagctacatctcagaaagtttgaatggcttgcttaacactaccaagctagttaatggtaaaatttggtttacaattttagaatccaagcctaactattcttttcttactaaaccattttgatttattctcagaaaaaggaataaattgaactatacctcagaagatacagggaagtttgcttatttcttttcattatattgcttttttgtcgtaatacctgggaatgatatgtgtcaatgtgagtcaaagaacttgttcttagatcgttatgagttatcaggaaaatattaacttgtcttaataatctgagcaagttatcaccagacttttaattttacctatttcctaaccccaaaagcacatatcagaaaaatttggcatattacaataaaaccatatgctagttggtaatattgaaatgaataataatgtcagacaatagtgtcacaatccaaccatttgcttgagtcaaaaacttataatcttccttgattctccattttttttgttgtttattgaactctccagccctatctaacccaacaggaaatcccattctctcttcttccaaaatattttaaaaccaatctcctctcaccgtctgcacagctagtacaagccgacagcatccttcccattgagtacagaatcagtcgtgaaactaatttccctacttcctcagattcttgttggagtcattttttacccagcagacagaatgatcttttcttaaacattttttaagttacgtaacataatgcacatatgagaaagtgcataaaacataaatacactgcttaactaattgttgtaaggtgaacactctagtagctattatcaatgggctcaataaatagaacattatctttacctagaagcaggagggacaggtatttctgatcaaaatcattttttcttttgtacatgtaactgtgttgatattttattgatacataatagttgtatgtatttggggggtacgtcttacattttcataacagtatgcaatgtgtaatgatcaagtcagggtaattgggatatccatcacctcaaacatttattttgtccttttgttgggaacattacaattcttctcttccagctattttgaaatatacaataaatattttttaactataatttccctgctgtgctattgaatactagaacttacttctatgtaactgtatttttgttatggtaataacttccttatttggtttatatgtactcacaaataatataaattttctaacttcttttagaattttctattaaaaaattatatcattgtttattatttttgtatctaacttattttatgatatacgtatctatgttgctgtgtgtttctgcacatagttttgttgatatagttgttccagttctctgttgctatgtaacaaaccactcctaactggcacagaaagaactgttttattatgttcatagattctgtgggttgggaattcaaacaaagtatagcttggagatttgtctctgcttcataaagcctggggtatcacctgaagaggctcagatgtctggggactagaattacctggagtcttcctcatttacatgtccagcagctgggctaaggtgacgaagcaaacactacaaatcagtgtgcctgcaagtgtctattaacataacctgggcttccttaaagcgtggtggtgtcagaggagtcaaatttcttacaagtggctcaatactccaagagaaaacgtttcagcagcgctggacagaaacacatacccttttatgaacacacgtccttttatgaatgaggacacatgacatcattttcaccaaattttgatgattagacctgccacaatcccaaatgtattcaaatggtggatccatggatccagcatattttaaacaacaaaatagtattccactgtgttaatatactataatttaattattcattctgttcttaatagatatttgagttgcttccattttgaactattatgaacaatacttctgtaaacattctttggtgtgtattctggtataggtcagcatgcatttctgaaagaaatatacataggaatataattgctaagttttagagtatgcaatattcagctttatgagataccatcaaaaggtttatcaaagtgattataccaatttacactgcccccaaacataaaagtgggaacactcttgccaacacaaactgagattttcggaatctaactttttttttttttttttgcttaatgtcccttggaaattccaatagcacttgacataaaaatgaaaccgtttaccgtggcctacagggcttagatgacctggtctctgcacttctctgtggacttatcttcaccttgccataaggctgcagcctcatgagcctcctttctagccctaaaacaagacaaactcattccccacctgggacccttgtacctgctctttcctctcctggaaagcacacatcccccaagtccaatatctgttcctcaaggaggacttgtgtgaccaccaatataaaatgcattccactccccacccctagtttctccctttaatgctattctgttttcatcagatcacataagcaccacataaaattatcttttttatatgcttgtttatttatattgtgtctattacccctagaatttatagtgtcttgaaatgtgtaaaagactgctttttgaattaatgcatttttataattaattaagtaattgagtaaacttacctagctgtgtgataataggtgttatgttttttattcttcttatgcatttatttatgtcaagcacagtgcttgggactagtggatgttcagtaatattaataattgaaataatttggctcacattaatgttgaagtggaaagaaattttgtgtcctagattggccaagttttaagatgggttgatcactctgggctctgagagattagaaagaactatgtttactcctctgtaagaaggccatttagataacccacctgactgtcctcattatcaattttctcctttttatttatttggtttctttctattgtctgttcactcaccctttgatggataatgctcaggcatcttctgcaggttagcctgacactaaaatttaactctcatatttttgaagcttcgataaaagtagtcgatgctggaaaactgtctctgacacagtgagcagctctttgttttgcagtaagtggagtctttaaaaagattgtgatttttattgtccctttctttgtgacaatcgtgtgaaagggtcagttaattatgcaaatttggaacttctgagaggaagccaattgagaagcagtgaatgaagcaacccaatcaccctggaggcagagataccccgtcctcttacttggaggctgtctcagctcaactgagtgcagtgactctttacctgcatacggcttgcgaaacccactcagagtctattcaatggatctgcagcagggtctgagaatctgcatttctaacaaatccccaggtgatgcagatgctggtggtctgagtgccacactcagagaaacactgctataagacgagctgttcttttccccctgaatatctgaatttgtcctttttgaacttccccttagaccccaaaggcctatactcaaaactccaattgtatatccagccccatcttctttttggagtgggactcccatgtctttcaatgatcactagacatttccaactaaatgagattttgacggttcatactcaatgaccttgggaaagtgccctaaaatccagcaccatttcctcttccatattttgagaaatagtgtgcctttgtttctcaagttaccaagacttaaatatttttccaccgttttacttctcgatctgaactcttggtttactttattatcataaatatgaagagtgatttctagctagagtaatagctactgatgacagatacatttatcactgtggaaaaaacacctacgtcagctctttctgaattctgacgcacagatcaaagcttggtaagtcttggtagtctgaacaagcgccttctggagaagtttaaatgtaaaacaaagatttccaagtgccatcatgggttaataattttgaatcagaaattgtgagaatgatgcccaagaatcagcatttttaataaataagccttgggccaaatttgcaagccactgacttagatcatcatacaataagatattttaatgccacttggttaagtctggaataatttaatccttcttttatacttaagggactaaatcaaaaggcacattttccagcaatattagtacttccaactcttctttttccaacagtgacttgatgtgtgtgcagatcaatgttagttttatgttactatattggtgttattttctttattccttgctgatacccactttgggactctgcatgcaaagtgcctggataatgatgtaacacagagaagggtcctcaccttgggttttcctctaagactcctctgctagcattcctcaagcttgccagagcagtttatgcacataattgatctaatctttatttatcaatgaaactagccctgcggtttttcccagaagactctttggataacacagaggcacaacagaaagggcaccatgttaaaaatagaataaataatattttacagccaaaatgattgtcaccacctgttatatctttctcatctctgggtctctcctttagatgcattttttcccagagatttcttctaaggcagaaccagcagggaagaaaacaatcaaatgctttgcagcctggagtaaactttcacaggacaggagaagatgtgagattctcagcttctcctcccaataaaaacagcagcaatggaacagcatctcatatttagatttcaacagactggagtagggacaggggacagaaattttgcaaatgatgcagcttagtcaatgaatggcaacatttcagaaagcttaaattcatatgatgagggaggagatatgtctgggaacgaaagactagggaagagtctaggtgtttattcagcatcttcactgccccatctctgcacacagtttttgctccataccttctttgccaccaacactactgcccaagtagttgcttctaccacatttaccaccaccatcacctccaccatctccactgccacaaccccaccatcagcatcaccctctccaccaccatccgttccaccatgacaataacttccaattccaactccactctcatctggactttcaaacctgccacttccatcaccatcacctcaccattatcaccactcatcccaccaccctcacccctcatgtcaccattatcacccctcaccccaccaccatcaccccttactccaccaccactacccaccaaccccagctttccagcttcctcctgctcaccttcacgttctctctgctgagcagaggagcttcttaacactggagtttaaacaattgatgaaacatcatccgtgtgttctctctacaatagagcagaaaagatacaatttcttttttggactcacatgagtaattcatatttcccatttgcctagggccaggttttcaagaacaaaagctctcaataggagaggctgtccggagaccttgtatctctgctctgtatttccatccccagcaggaatggttcggggcactgcttggctttgccctgggttacattttcctctatgcgagtttccaacctgaagtcagatctgtttaaaataaaatgaaagcctctgtcagggagaaatatcaaaggatgactcttgcctagaggtagcacctacttttaatttttaagtattttatagagaaacatgtaaatttacacaatctgcagaattgttatttgcaggaacctatggtctcttcagagggaaattagaagttagaaagtcttaagaccttggtttgctgtattttaaaaggttcagtttttcttaaaatgacggtgtgaatcttttactcaagaattgtaactaggctggtcacggtgactcatgcctgtaagcccagcgctttgggaggccaaagtggaaggactgcttgagcccaggagttcacatggcaagacctcatctctacaaaaaatttttaaaaactagctgggcatggtggaatgtgcctgtcgttccagctactcaggatgctaaggtgggaggatcacttgagcctaggagtttgagactgcagtgagctgtgattgcatcactgcactccagcctgggcaacagggtgagacattgacacacacacacacacacacacacacacacacacaattataattaaaaaaaaacgagcagtatcaatgtctttgttctcacctctgtatctctacagcttcctcctactccgactttcacctccacagtcttttgtttgtttgtttgtttgtctgtctttgtttgcttgtttgtttttgtctgtcataagcattccaagatgaaaaactgagtgcctgtcacaaaactgaaaaagttcacagctctgagctcacaaatacatggttttggggttacataggccagatatccagtttataaaacaaagaaatataggcttggctaatgcccaaggatagaacaccacccatgattccgtattttttaagatgcgatggtttccctgggcaacagtgttgaattacgtacatgcatcacgtacagctgtatacagcgtgtggtccatataaaattaagcccacgaggactgattccatacaggaagctcctcatcttcgtttccctactacatttatcataataacaattcaaatggtctggatactaaacataacaattcctgaaaggatctttcattttagactgcttgaaacaatgattttttgataatgagtgagcactctgaattgaaaatgatatacaatttactgcaaataatcatacactaaaaacatatataggaaggaaggaattaacaaactggctataaacatatttgattctcaatcctaagaggaccacaaattatatatatgaactttgatgagttgggttatctgagttttattttcttgatttgtaaacaggaataaaataccaaaattatagacaatatttgcaaagtgcttggctcctgcacgcagtaaatagtgtctctacatactttggcttgtgctcttagtctttagttccttctcaacaatcctgtgcctaagaaataggtattgctggttggtatctgctgtactgtatgatctatgttctttgctctttgtttcaaaatcttactaccttattctagtttggagtctttgtgagaggcacaggtacatggtctgataacattttgagtctttaatccaagtgcttgtcaccattgtctttggcagaagcattatgtctatggaattaaattttttttttttttcactgtacagttttagtgtaggaagggagaggaaaccactttcagtgggatcaggtttacttggcttggagaagaaactgaatgtggattcctcatcaagaatatgcttgtaacactagtaaatatttccctagtaacaatagctgggaggaggaaatcatgtttaataacttaatgccaaatagcctgtggcttacagtggcacgcatgaacacacacacacacacacacacacacacacacacacacacacacaccacgagctggccattagctcaataactgttttaaaactctattatttatctcattttagtaaatcagataatcaatatttatcgattatgttcatcaccattttggtagacactatgacggataacaaaaggtaataggcatagtctccacttggaaagccattacagtatttaacaaagcaatacaaccatttgataccaattaaaagtaagttttggtttggaatggtagtaacttccagtgacgtgagctttcagaggatggcagctagttaatatagtattctctttgaaaaagacaactgttgatgtgtggagtgttagctatgttcaaattgagaacgtgagtgaagacttattattccccttctgttaacatctcatctcttcatctttctggatcttaggcttttttttttcctcgacattagtactgtacaattgtaatatgtaatttaagatattctaatagcctcattttttaaaaagtaacaataagtatctggaattaactataatgatatattttgtttaatttgatatatcccaaatattaccatgtcagcatattgcactggcacgtttgaggcacccgatagctgcatgtggttagtggctaccgtagtagatatggtggctctcgagggtcctcatgcagtggctgcaggacctgacctgagcttcatcacatctcttattttagaaaaaaaaagctgactccattgatggacgttcagcattgtgtcaagaacagggaatttctcctgtcaaagccttctttattgtttcttcttcaatttacccacagcggtcctggctaggatcctgtcatggttctcagtccttccctctttccttcagttgctgctgttgctgtccagctgaagattaaggtagaaccaaccgtggaggagctgccatgggcttttgttgtctacgggtttggggatgggacatccagaggggcctggcaggagtttaattaggattacagatgagggagacagaggaaagcaatggcaagagaagggggcaaacctgaacagaaggttccctccacccttctgctccctctcacttcaatgctggagtaataggatctgccaaatctcactttccccacctgggatggtgttggcaggtggtagggtcaaagagtaaagagaagcgagtctcatgtgggcattttcaattccatcacatacttttacttacatttgcatacaggtcagagtcaaaaatattctattttggtacctgatctgaaattatttgtaaataagacaattaaattcatttactccaaaaccatcacctcaacatctgaagaatgcccagcattgagccaagcactcatgtactaggaaaggtaggaagtggcccccgttctcaagggtccctgtcacacattagctaggaagtttggaggggtcatcaaactgaaactttccagaaacatctgtctgcattgagggtatattcaggacagaagggttacaatcatgtctgcttcatttttacttgtatgtagtatactttttaagttgtttttcaaaaaagttagtatctaagtggacaaaattaataggagcaattataggagcataacctaggtagagctgcctaatggttgaccttctaacagtggaatttcagtcatcactaaatacgtagaagacgcattcagggaatacactgtctttctactccctcaattatgtcactgctttatctgagagcaatggagttgtgtaggctggtgcactgaaaactgtcaattgggagtcaaatatctctcatttttcaagtagtagccagcctctggggtttgagcaggtcccagttcagccacctgttttttgtttatctttggccaatcacttaaattttcttagtttttttttttttttccacttctaaaatgagactaataacttcatctagttacctatcagttgcaaagaaatgagataaaaaagctatctatgaagacacatctcctcaaatgtgtttggcatcccaacagtaaatatagatcatgttactcttgaaataaaggccaaaaaatgtcttcactccccgtgtagaataaaatgcagtctgcttattacagtcttgaccatgcacaccaagggcactgtctccagctgacactgtgcgccagtcacgttggcctctaaacatgttcctccctttgttagcccttttttgtctttggaatgttcctccccaagggcaaaggtcaacaaactttcactctaaaaggccagatagtaaatagtttcatcttgggggccatgaggtttctgtcacaactactcaactctgccatcagagaagaaaagcagccataggcaatacataaacaaatgagcaggcctctgtttctctgttccaacaaaactttatttacacaaataggtgatgggctagacttggtccatgggccaccatcgtttgctgacccctccctagaccttttcataatggcttttctgatcattttaatctcagatcaattaggatctaaggccttccttgaccactcttttgaacatctccccaccccatctcttgattgtgttgctccgttttattgttttcttattatttataacctcaattatctaatgtattcattcgcttattgatttattgtacacatccattttctgtaccaccataattctagttcgaagggcaaggtctggaagaaagtagatggtaggtgctcaataaatgatttgtttcatgtgtgaataaataattacccaaagaataaaattccagaaggaaaattctgaattttagtgataggaaggcaagaacgcttgggggtagtcagaggcacaggaagatcagaaactcctgcaaactatgagccttccatataatctttcacaaatgaagcttctaaaaagctgacctgtatgaaacaaggtagttttttattgttgttgtctgcgcatgatatagactgttaatatctcactattttctggctataaaacaagcatactgataacagtaaaaatcaaaggtataaataaccggcccattagcaggctgtatgcttggaaatggttttgagggagacttttaaaggcagcttttaataagaccagccattcattccccatgcaatcaatcagcattctcaatcaaatgccaatggcatgcctttgtggttgctactgaggatactggcaaaatgaggcagcctctgccttctcagccatcaagagtaattatgtaatgccatatagacaaagattagacctatagtgatagggggatatcagccagtgtcctggccaaaaaaaaaaaaaggctcacatgaaaggatttaaccaaagagatgttaatgaagctatgccactcttatgtacagaggtgaggatgaggctaaagaaaccattcaggagatgtgagggaccctgggtccagcaacagttggaaaccactctaacctgtaggctagaagtcttagggagaaaatgatattaccagagtccagtgagaactgatgcctgaaggaggggccagccaataggagttctggccgtagagaaatgtggctcttactagaatctcatcaagacaagctttctatacttccaccctgcctgacataacaggaagtcagagggtaagagagctggtgtatgcaattcatgggagtcgggctttcagagcaccaagtaaggtggagaaatgcatgtgacattaagaactgagaacaaaagaaacataacaggcacagtagtaagagtaggtaagccaggtgataagagagattgcattttggaagtctgtatttactccattgattttatttactttgcaatatgtgaatgcagcagaaaataagggattaaaaaagcttttagaaatgtgtattttttaatacttaaggatgtaggctagaagagttctaggattattggcagagtttatctaactcaagccaattcatgtgaagtcaaccagagtcttgaaggattagaaaatacctttctagcctgttgcctggggaagaaacattccgaactaaggataatcttttgcctgggaagaagaaaccatagagtaaaattcatcaccaagataacattgaatcttcattactgcccaaaaagagagagagagagagaaatttaacatattcctggtaatgaaggtcagtcacttataagcaataatttccttttttttgaccattatcaataaaaatgaaatctctctttagcctgccaaaagaaaaaattataaaaacaggacctgttacaggctctattacagaactttgaaactggtatcttaggactatgctctctaacagagggtcatttcttcaagtaactatatgttgaactcttattatcaaatgatgaattccagtctcccaaattactacttgcttttattaattgagttagtgatgcattacctcactttgttgcatagtttttggtccaccaagtggctgcacgaaagaaggaaatgaagtgctggggatttccttaggcgattacaagaagacaacttttaataccaaagtatttatcatttatgattttcctagttgtcttgcagtgatctaagcaacttgttttgtgatttattatagatcttatttaggtctgtttttttaaagagaagtttcaaggaaaaaggaacctctataaaataatttcagtcggtgtcgctgttcagtagatgacatctgctggaatgaatatggtctagatgctgctccatctcctttacagattgtatgcttgtctagaggatgtatgccacattttatccatgaaccttttctaccacacgcaccattctttatccccatgccccatcattacgccaatgccattccctaataaatgaatgtgaggggttttaattattttgtgccaaatttcttcaagcaactatatgttgaactcttattatcaaatgatgagtttgagtctccaaaattactacttgttttcattaattgacttagtgatacgttacctaactctgttgcatagttttggtccactaagtggctgcaggaaggaaggaaatgaagtgctgggcatttcgttaggcgattacaagaacacaacttttaataccaaagtatttatcatttatgattttcctagttctcttgcagtgagctaagcaacttgttttgtgatttatttattggaacttactaagcttttttttttttttagatagacgtttcaaggaaaaaggaagtttcataaaataatttcaatagatgtctcgttaaaattcaagttgatttcagtgctattctgacctagctaccaactagctttgagaccccaaacaagccacttaccctctgtgatcctcagttttctcatctctaaaatgagggggatgggctaagttgtccctaaagccctctaaagtgctacatgctgtaattatgagtctatgttatccccggaaatatcatgaaaaataaaaataaaattgattgagttgaaaatggtccaacagttacaaagaaatatttgacattgtaatcatgcatcagttagtttttggctctttaattttgaaagcagatgtttgattgcttgtttaaagcctgcgtaaaaaaccccaggcaaaccttgcaaaagctcaaaatattcttaagcagggatatcaattgcataatttcctagaccttgcagattggttcaaattaacccacagcatatttgaaagcctttttcttttgtgagcatctaaccaattccccattgctctcctcctgggtatctattcgttatcaaaaccggaagcacagtgtggcatccaaattggagttcagtgtcagcagaggttacatttgtacatttcccagaaaaggaacaattattgtcataggagaggattaatgtacggccattttgggtctttattataatcttttctttaagaatgaggaattggaatgttaatgtattcaataatctatgaattatacaggtatgctatagtgctttgaccttttcaacatttggtaattttgattgagtggctgttctgagcctgttctttttaacagctctattatcctgtggaaaagaggaaggctagccaaatttcaaaaacacatttatcccgaagcaagaatagagggaattagttacaatgtgccagagagagtgcaagatgacttacagaccttctctgatgtaacctcaacaacatctcatgagataatattattatcaccattttacagatgaagaaattgggacccaatgcatgcctcatgggtaagaggcagaggcaataataatcccagtactatatgatatcaacatctatacacttgcacaaaggtaagagggagaggcaattattacccctgtactatgtgataccaaattctatacacttcctactcaacaggtctttgatttttgaaagtagtaagtgtatctattaagcagtaaatacctgtaaacatcctgcattagactgttctcacactgctaatgaagacatacctgagacagggtaatttataaaggaaagaagtttaattgactcacagtgcagcatggctggggaggcctcaggaaattaaaaatcctgttggaaggcaccacttcacagggcatcaggagatggaacgagtgctgaggggaaggggaagccctctatataaaaccatcagaccttgtgagaactcactcactatcacaagaacagcatgggggaactgcccccgtaatctaatcacctcccatgagttcccttcgacaaaacatggggattatgggaactacaactggcgatgagatttgggtgggtgcacagccaaaccatatcattcttcccctggaccctcccaaatctcatgtcctcacatttcaaaatgatatgtctccgatgagtggaggaacacccggttcttcatcttcagtcaaattagataaaacaacatggatacacatggaatggttttgagaagtggagagtttaatatgcaagaaggaagtggggagaaagaaagaagcagatccctggtacacagacagagggagggggcctccaaagccaaaagagggaacttcaagtgccaaggataccagccagttttatgagtaggctggaggaggtggtgtctgatttgcatagggctcacgggattggtttcaccaggtatgtcgttcacatagcccgtgaaaaagctggccctcccaccctagcctgttgatatgcaaatgcagggcaccatgatgttctacacactggggatatgtgggggtggctatgctgctaggcatatgtgagggcaaggataagaggacaatggtggtgagaattgccatgtttgatggactcagtttctaatggctggcatttgcacatcaaagattgcctgccaggctctaaaagtgggggttttccttctagacaagaagcatttttgcagctgctttaaaagaaacgaaaactttttctatctgcctaaaataatttcttaataactcctaccacaaaaacacaaccccactttcccaacagtcccacaaagtcttaagtcattccagcattaactcaaaagttcgagtccaaagtctcatctgaggcaaagcaagtcccttccacctatgagtctaaaacaaaaaggaagttagttacttcctagatacaatggggtacaggcattggttaaatacatcctttccaaatgggagaaattggccaaaacaaaggggctacaagctccatgcaagtccaaaatccaatagggtagtaattaaatcttaaagttccaaagatgatgtcttttgactccatgtctcacttcttctgagtcatgctggtgtaagaagttggctcccacagccttaggcagctccacccctgtggttttgcagagtacagctcccctcttggctgctttcatgggctggagttgagtgtctgtgaattttccaggtacatggtgcaagctgttagtgaatctacaattctggggtcaggaggatggtggccctcttctcacagctctactaggtccaccaggcagtgcccagtggggactctgtgtgagggctcccaccacccattttccttccacactgccctagcagaggttctccatgacggctttgcccctgcagcagactttgcccctgaacatccagatgtttttttacatcctctgaaatctaggcggaggttcccaaacctcagttcatgactttggtgcacccacaggctcaacagcacttggaaggtgccaaaccttgaggcttgcactctgaagccatgacccaatctgtaccttggccccttttagccacaaatggagcgaccgagacacaggacaccaagtccctaggctgcacacagcagggggcccagggcctggcccatgagaccattttttcctcttagcctctcagcctgtaatgggaggggctgccacaaaggtctctgacatgccctgaagacattttccccgttgtcttggtgattagcatgtggctccttgtttcttatgcaaattactgtagcagggttgaatttctccccagaaaattggttttgcttttgtattgcattgccaggctgcaaattttccaaacttttttttttttaatgctttaagttctagggtacatttgcacaatgtgcaagttcgttacatatgtatacatgcgccatgttatgctctgcttcctcttgaatactttgctgcttagaaatttcttctgccagatactctaaatcatctctctcaagttcaaacttccacaaatctctaggacacgggcaaaatgccaccagtctctttgcagagcaagaatgacatttactctagttctcaacaagttcctcatctccatctgagaccacctcagcctggactttactgttcatatctctgtcagcattttggccaaagccactcaacaagactctaggaagtttcaaattttctcacattttcctatcttcttctgagtcctccaaactgttccaccctctgcctgttatccagttccaaagctgtttccatgttttcaggtatctttacagcagcaccctactctaccggtaccaatttactgtattacttctcacattgctaataaagacatacccaagactgggtaatttataaaggaaagatgtttaactgactcacagttcagcatggctggggaggcctcaggaaagttacaatcctgggggaagggaactctttgcagggaggcagaaaagagaatgagtgccaaacaaaacgggaagccctttgtaaaaccatcagatctcatgaaaactctgtcatgagaacagcatgggagaaccacccccataatctaatcaccccccacgaagtccctcaagcaaaacatgggaattatgggaaatgtaattcaagatgagatctgggtggaggcacagccaaaacatatcccatcttaaaattttatcttattccacattgagctttcaagcatttattagtacttatgatgccctgtaaccttctgtagctggtagaatgatgaaaaagaccaaaattccccaccccaaaggagattagagctgcggagtatattgactcagggttatgggaacacaaaagagatggtgaagcacccagagatgagtgattctggtgaactggtatgtaacacttctgctcagagcataaggaacagtggaaggaaacagtgttaccagggccatatggaaatttgaacagtggatgtaggactacccagtaggagctacttccaaaaatggtatgctatggctagaaaggagggaaataaaataacccattctctctgttgttctctgttctcttaccagtgtcccccattagctgaatccagccagatgtcagccatcacaaaaactcagtctctaagggtttcactcagagcagggcaaggatggatggaaagggactgggaggaaggcatgtagaatcatcaacagaagggctttccaaaactaaagaataatgtggcttgaagataaagtcacatctccatttctttcaaaacagagtaccagcaatttttaattgattttttcctcagcttctacttaccaaaattctctggagttttaaccagagtagtcttatgtgtggaatgaagaggggaataaatggtaccaaggataataggatgagctcaaatcagtctgtgcttatgaccttagtgttaatactgtgaaatgaaagaaatatcgtcatttctcattttggtgtagagatgctaattctacactcctcttcaaattactgagataatagtatgtgactgatgatgaattcctagataacactgggctgtgtgcctttgaaatattgagagaaaaactcatgatattgatagtccattagactagaagatgagatttcaaaatgacaatggtaatgagggttcgtttttggcaaccaccttgattcagttctataaaaggcaaagaaataaatacatgactcccctgagtgacatttagacaaaaggtggttctgtgccattgtcggatagctttcaaaatcaatggattcagcaagttttgttcatttcagatatttggtacatcagagttccatgttagtttttttttttattttaagatttaattattagaaataaatgtacttagaatattggagacaggaaagaatattaggaaattttgttattgctaggaagaatctaaaaatagcgttaattgattaaaaagtgaattattgtgttagaaactttgtcttttaacaattacaaaccaaaattctaaaggaatatctaaaaagcttatgtaataaagtttcagaagactaggaaaaatagccttataagctctagatcctctctaacagagatactgttgtaggtaaaggagacacatgctccaataataagatgaaaccctggtaaccctggagtggcatcctctagcaaacaggagagtaggctttggtttgattcactcaacaagtgctcattgagaatcttctccgtgcagttaactcaatgctgtggaaggtataaagctatcataatatcagctgtagacaaatgaaaaggaatgcagttatcaagaacttcagagaagtgcactttttgctgagagctttggtaacctcatctgtcagtgtaaaatcaatcagggatcttccctgtaggctccgagagtgactatatatttctcccttcaaaatgttttatccaagataattagtttaacatttaatatctgggacttcctcacaggaggaaaatgtcatgaaagaggaaagcattggaatctagaaagtgataatataaaagttgaaagaggcatatttagtctgctttgcctttgagaggaattgtatgcctgttgagttctatttcttttaccttcatgtgctggctggctgagtcactgggcaactgggacccagggtgtccacctgaccaggtataatttcaatcatgcatacagttgtcccaggattttcttgggttatagaatattttctaaacataaagaagctatctctcttgcttctctcccgaagaattactttcttatcagcttaggcataaaccgaaaggatgctcaattatatgtgcataaaataatgattcattgaagcattctatgaattttatgttcccccccaactccaaacacagacccagaatttgagataaagagacatatgcaatttaatattatttaatgcgtgacgagtctgatggaatagatattcaactcagtgaccttgaagtatagagtggctagtatgaacagtttgcatgctacactgtatagcctaaataacagagggcataataaagtaaaaactgtaaggttgtgatcagcttctactggtgagggagagagatgattaatggtgtaacgaagaaattatcatggtgtttctattttctacaaagctgttttcagcttcaaattagaagttactctttttgccaaaaagagtggggtataaaccacattccaattgctgcaataattctgacaaactcaaaggcagatagcaaagcatctggaaatgggcagatcaaaatgttgtcttgaaaaatagaaaaacaacctttccaatggaaaaatacctggtttgtagcattttgcagcatatgtaatgtatagagtaaaatgtatgccctgggtagctaagaagagaataaaaatgaattaggagaacctaaataataaaataatgttgttttcataattatatataatgggaacaatttatttactgacttcactgaaacatgatgtttcagagcttttaatcggcttgtgaaatgttagaattatttctgtctcaaaatatgtaaaagtatggtggaggagaaatagtaataccttttcctcacccagggacctatggaaaaggtcatgcctgacacctctaatccaaaagatagactggcaaattaaaagcataaaaagtttatttatcaaaatttcatgtggcatgggagcttttggaattaaagttgcaaagggccagagaaaattttttattttttttgagatggagtctcctctgtcacccaggctagcgtgcaatgtcatgacctcagctccctgcaacctccgcctcccaggttcaagtgattcttctgcctcagcctcccagctagctgggattacaggagcataaccccatgcctggctaatttttgtatttttagtagagatggggttcaccatattggccaggctggtcccatcctcttggccttgtgatctgcctgcctcggcctcccaaagtgctgggattacaggcgtgagccaccgtgctgggccaagaagactatttttattgctaagtctgatgaaagaaatggatagttgtagagaaacatgattggataacaggagtatgatctaatggtaatgaactggagacaacttcgcaaggccagattcttctctgtgtttctgtaagccattcattgcccctgggtatcaggaagcacatctgtcacatgaggatctgggaggtggtgaacgtcagagagtgatttttctaggttttatggcttgtttgggggtcaggagggggcgatttctcattcctgtgacctgcttgggggagaaaaggatgttaagttctcttatgggagtttgcagatactgttttgactctgaatatagagactttataactaagccatggtcctcaaatcaaaagtaatccgtatgtggtaatctggagaggtgtgtaataattattcttgtagattcagaccatcctaaccataatcaatgctgggcaggtaataggagatgttttatggcaaatgattcagtcaatgttccaattattgaagctctatgtaggagaaagacaactgtagatactggtttgtctatagatccattgaaaaaaactggggtactgacttgttgaccatgactcatggggacaagaccacaactgcagcttagtatctaattatggccataagccaccaactacttaataattgtctatatctagtaaatatggcatatatgtttacggtatatacctggactcctagtattctctttgagccacttttttgatttattaattgttacttgctttgtgtgtgtgtgtgtttgtgtgtgcatgcatgtgtgtgtgcatgtacaagtgtttaatccattagtctcttagcatataaaaatgtttttcttgtaaaaagatgcctacctatttagcctgtgcagtggaggaagctgggggaggtagatcaagtacaactgagaattttgtgaggattcaaaggctcaacatttttacttccttgtgagcctttctgccttgcaaaggtcaacacactcacgtctcttccccctccagcaatagtgttttcagatatgagcaaaatattttacctcaagtttcaccattttctttttttacaataacagaaagcagatttttattcagagtacacttacagtggctttgtttttcttgctttgtagaaaaaaacagcatttatttatttattcattttgttgttgtcagagtcaaaatgtaaatttcttcttccatttactttgacattgcactgtatatgtactatttttgaaaagagtggcatattctgtgaacaggtctttcagagacaaaggaaataaaacatggagaacaatgcaagtttcatcctctgataatgggtagatggtctacggccataccaccctgaacactccccgtctcgtctgataatgggtagatgttctcaaaaggcaaagtatatgaaaaactttaatgtaagaagaacataacataacttttatatacaattatataattcaacataacgttaatcatcattttattagcacttttttatcattgttagatatagaaacatagatgcattaatatatacataaacatgacatatttctacatgcacacaaatatggagttaacgtttatttagaatctactaatatgcttgtggtagaactacaaagatgaattatatgaaaatcttatagtttagatggaggtaacttaaactacacataaaattcctggaatagcgccttccatgaacaaggcactcaaggaaaatttgtgcaataaatgaatacataaaacaacacaagtacaaagcagcatgtgctgtttggtaagctaaaatgcaccagaaggttcaagagttaaaagacatagaagaagcctgaaggcaatgaaactattgatgtatttgcagagaagttagtcattgaagtgtccaagcaggcaggtgcacatgcactgggatgcagctatgcaggttggaggaggcaggctccgcagatagggagagaagaaagcggtgtatctgattttcttttcttttctgtttttggagagagatattgaaaatgaataaacagtccagggcatagaaaagtttgtgcaataggggaaaataaagtaaattcaagggaaaataatagtctaaggtctcctataaaaatagtctagttactaggccaggtgcggtggctcaggcctgtaatcccagcattttgggagaccgaggagagtggatcacgaggtcaggagttcaagaccaccctggccaagatggtgaaaccccatctctactaaaaaactacaaaaattagccaggcactgtagcaggcaactgtaatctcagctactcgggaggctgaagaaggagaactgcttgaaccgggggcagcagaggtagcagtgagccaagatcgagccactgcactccagcctgggcgacagagtgagactccatctcaaaaataaataaataaataaatataaatagactagttactgatgagtatagctatttacaaagggacacataagacgtttttgtcttttttttttttaattttttttttttgagacagagtgtcgctcttgtcacccaggctggagtgcaatggcaagacctcggctcactgcaacctccgcctcccaggttcaagcaattctcccgcctaagcctcacaggcgcctgccactacactcagctaattttttttttttttgtatttttggtagagatgggttttcgccatgttggccaggctggtctcgaatgcctgacctcaggtggtcctcccgtctcagcctcccaaagtgctcggattacaggcgtgagccaccgtgcctggccggacgtttttttttaagagaaggacagaagtcaagttatgtatcttcttaaatagggaaatacattttacttcctctaccattattactattttttcaaggttcctaaaatagttgtcattttacataacgttttcaaacatctgtgacagatcttgaaagcgtcactatgcgtttccttaaaagaacacccatttcagaacccgtgtcgtctctttttcttccttttccacttccacgtccatgcgatcaagttgggttcaagctgccgctgcggcctgtcttgaacccacccattttcctctaagctctgctgccctgggcctactgactcctgtcctctcactgtccttactgctgtcctctcctgggctgatggccgaaaacgcctccctcacgggctcctcaccctaagtaggtaggtctctcccaccttccatctaattttcacagtcccatcagaattttctttataaaggctggtatggctacctaagttcccgttattgcccagaagataatcccaaactgcctaatatggtattgatagctctcaaaatggggccatcgagtaccccccttacactatctcccattcgtttatcccatctacaccgagattcagtcaacctgctttgcttttcccaaatagtcaaagatgacgcatgtttcccatcctctgttctgtgctgttcattcaagttttttccttgcctggagtatcctcctttctttcttttagtcagaaaagttctattcacatttcaagatccataaaatgtcacgttctgtttactcacttattgtaaaaacgtgtactctcttaacttcgcctttctatttatacacaacttacatgtacgtaaatgtgccttctcccctccccgttacacccagcacacatattgcctagcacacagtaggttcataagaactgttgaatgaaattttcaaatcgaagcagatataacaacctcttattttttttaaaaccacttttgtcaatttattcagcctaatgaatatttttctatatatctgccatatgtatagaaaagtttatacatagtttctttatcaggcctaacagaataacttttactgtattaaatagtaacttactcaacttgtcaaactggagaggcaattgatttgagtattaggtctttacattgcatcaaccaagttgattagtcatttttaaatttatcattagttaacattaaaaaaaaagttaaaaacaagcattgctcaagcccccttgtttcgtgtttggcacactgcatagcttttaataaaaagttatttttcaacctgcagtggaatatttaaacatccatgcaaagattttttttttttttttttttttttttttttttttttgctaaattttcaaagaacatcagaaatgttgtattaaaaaacagatgatggggcagtaaagacttttttatttggtagtagaaacatatggggaaataaaatgtattaatgttgtaattataacattccaatgtttctgctttctcaagtttttatactaaaaatctttcaatagaacataactttaaagatagttttctttatactaggttcatgcatttgtgtcccatatttcaccataagggatatttgtaatatatttctggaatgggaaatgggtcaactatctagctgtccagtatttcacatttatgaacagaacccccaaactgaaaattagccttgggtgtttcataacttaggaccaactcagaaatgtaggctttggaaagcaaataactgtgatccaattttcgggaagcaggtttgtcttttatggcaaagaagagtgatcccagttttaattacaggcattgagtgtccctagccaaaactcagtctgaggtgtttcagcatggaagatcatttgggaaagctgggtttgcagaaagcacgagcaataaagacataacatataaacagatattctgcacgtagtttgcaaaatcttaacctcatcaaaagaagagatcaaaattctatttaatgcaattggagattaagttgcagagtacaatttaactgaaatacagtaccacattcatacttcaaatggtttatcaaaagaaagactaaaaaagactggttatgtgtctatataaggtttgctcttctctttctctctctttaattaaaaaaaatatatatatatataatatatatgtatatatataaccaaggcaaaaagtaagaggttgatgctctctgtccaaacctctcttctctctctttttttaaatatgtgcttaatatattcctatcttcccaatattttaattaagaacaatgtttgcacacatttaaatgagtgacatctttgcttaaatttgtttttgactaattattttccacgtgttttcaccttccaacactaccttagtcctaagttatgaaatactcaatgctcttcataaaatatcttgaaataactttttatttcaaaattaaaattaaatcacataaaagtatgttcttaaatagactatagttttcttagatcttgttgagattaaaaacaagtgtgatctggccctggccgggggtggtggctcacgcctgtaatcccagcacttttggaggccgaggcaggtggatcaggaggtcaggagatcgagaccatcctggctaacacggtgaaacaccgcctctactaaaaactacaaaaaaattagccgggcgtgttggtgggttcctgtagtcccagctactcaggaggctgaggcaggagaaatgcttgaatccaagagttcgaggttgcagtgagccgagatcgcaccactccactccagcctggcgacagagcgagactccgtctcaaaataaataaataaataaatgaataaataaacaaattacctttaacttagtatgaccattttggattgctgtaaaatattccataaaatagtaagagccttcaaatgtaacttagagtaaatgggcaaatattatttttcctatttacagagatatctaatagcccaaacaaatatttgaaatcaaagttatatttgaatgcatttctgaatagatgaagggataaacagatagtaatataaaggagttctgcaatgctatgtctatagacctcatgccaaaaatggggacatgagtcaagtctacctaacatgtttctattttctaaaaaaaaaaatttaagtactttaaatgcttatgctttgaataagaataattgccatttcaaaaaatgtaactaaatatgtatgcatgcatctgtgtgtatacagagacaagcagtgatttataattttgagaaatacgatattctgattctgattaaaatagctaaaattcacaaattcaaagttgtgaaactaaaaaagaaatttttttagacttgtggattaaaatcttggcattctactcatttaactgtatttatctatggcattttcatttggcataattttcatatattttgtaataatatcacattggctgcataatatgaagtcccttgaaagaaactagatttcaattctgtggaagaaataatttatgatgtaagagttgtgattatacagccaatatgagttaattctttaaaaaaaaaaactaaattgatcaagcaaaaaaatgtactcacttgtttgagaatgtcaatcattttcaattaaattatctagatgtttcccaggtttcagctgatatatttttcttaggaaataatattttatctcattaaattatttctcttgaatacaaaaaatctttatttagccatcagaccaaaaataaataaataaatagggacagctcagaaggagtgagcatagttctttctcttccaaacatacaggtggaacgtatagtgctaacagggaatattctgtgacatcataattttgggcactgaattttgattgcagtgtgttcttcagagtcaggcacctccaagtctgcctcttaatactgccagctgatgcctctaagcctcagttttcacatcagccaatgtgaccactattacatacgtcattgtgctactgtcaggatgacataaagatgctgcatagaacacgtttagcccaaagcctggcacgtgataagaatacaataaactatacctatagtcagggcaacagaaagacaagaattgatatggtcaaaatcataaaccctctttttgtcctacggaaggcacaggcaagaatttggatgacacatggtggtgcttctgcccttactagtgacctaaaaccaatctgccaaagtataatgattgagttttgcagaactgttgctaagagatatataggtgtatatgtacatgtatacgtatataaacatatacacacacctatgtatatataagccatatctacacacctatgtatatataagccatatctacgcacctatgtatatataagccatatctacgcacctatgtatatataagccatatctacgcacctatgtatatataagccatatctacacacctatgtatatataagccatatctacacacctatgtatatatataggccatatctacacacctatgtatatataagacatatctacacacctatgtatatataagccatgtctacacacctatgtatatataagccatgtctacacacctatgtatataaaagacatgtctacacacctatgtatataaaagacatatctacacacctatgtatatataagccatatctacacacctatgtatatataagccatatctacacacctatgtacatatcagccatatctacacacctatgtatatataagccatatctacgcacctatgtatatataagacatatctacgcacctatgtatatataagccatatctacgcacctatgtatatataagccatatctacgcacctatgtatatataagccatatctaagcacctatgtatatataagccatatctacacacctatgtatatatataggccatatctacacacctatgtatatataagacatatctacacacctatgtatatataagccatgtctacgcacctatgtatatataagccatgtctacgcacctatgtatatataagccatgtctacacacctatgtatatataagccatgtctacacacctatgtatatataagccatgtctacacacctatgtatataaaagacatatctacacaactatgtatatataagccatatctacacacctatgtatatataagccatatctacacacctatgtatatataagccatatctacacacctatgtatataaaagacatatctacacacctatgtatataaaagacatatctacacacctatgtacatatcagccatatctacacacctatgtatatataagccatatctacacacctatgtatatataagccatatctacacacctatgtatatataagacatatctacacacctatgtatatataagccatatctacacacctatgtatatataggacatatctacatacctatgtatatataggacatatctacacacctatgtgtatataggacatatctacacacctatgtatatatataggccatatctacacacctatgtatatataagacatatctacacacctatgtatatataagccatatctacacacctatgtatatataagacatatctacacacctatttatatataagccatatttacacacctatgtatatataagacatatctacacacctatgtatatataagacatatacccacagcgattttctatcacgttcgtttttaatcaaataatattagtcaaaaataaatacgtgtttgttttattattcctttgcttagttcctgccagtactagctggcttttctagtggaaggctgatcactttttccataaatccatttaatccaatcagtcttggcaggattgagacatgttctcagtggaggtcaagatcttgtttcctggtcactaagagcatgggataatagtaaactccagaaccatttgtaaaatactgtcagtcagacaaatccaaatacctgtcatgtgcccagtaagttattgaactttaagagaataaagtatgacccttattattgtgtttctaatcttctcagaaagggaaaaaagactatatataattagtgctcagctgtacaattcagcatataagtagaaattatttcactatgaaatcagataattgagacaaaattttagattgagtgagtaataatagccttatcttcttttgccctttatcctcttcccacatttaaactaggaagagaaatgaaacaagtcacctgtggatgttattggagagtattggatatgattctttgctcttacctggtgctctttcaccccacccctaactttctccttaactctctggcaattccatgcaaggccacctaaaatacccctttctcaataaagattttcctgaattcccacctaaaaataatttcttccttctctgcctttcatagcactttatgtgtgctgctccatttgtgacccatgtgtattctgttttagttatttatcaggggaaattcagccagatatcgggcaaaattcaccctcgatatttcatgtaggttcttttctgttttccctaagcattggccagtttgggaaataaagggacagagtacaaaagagagaaattttaaagctgggcttccgggggagaaatcacatttcgggaggttctgtgatgccccacaagccgcaaaaccagcaagtttttattagtgattttcaaaggggagggagtgtacgaatagcgtgtgggtcacaagagatcacgtggttcacaaggtaatagaatatcactaggaaaatggaggcagggcgagatcacaggaccacaggactggggcgaaatttaaattgctaatgaagtttcgggcacccattgtcattgataacttcttatcaggggacagggtttgagagcagacaaccggtctgaccaaaaatgtattaggcgggaatttcctcgtcctaataaacctgtgagcactatgggagactggggcttatttcatccctacagctccataaaagatggccgcacccaagggggccaatttagagacccacctcagtgatgcattctctttctcaaggatgttccttgctgagaaaaataattcagtgatatttctcccatttgcttttgaaagaagagaaatatggctctgttccacccggtcactggtggtcagagtttaaggttatctctcttgttccctgaacattgctgttatcctgttcttttttcaaggtgcccagatttcatattgttcaaacacacatgctctaaaatttgtggagttaatgcaatcatcacagggtcatgaggtgacatacatcctcctcagtttacaagatgacaggattaagagattaaagtaaagacaggcataggaaatcacaagggtattgattggggaagtgataagtgtccatgaaatcttcacaatctatgttcagagattgcagtaaagacaggcataagaaattataaaagtattaatttggggaactaataaatgtacatgaaatcttcacaatccacgttcttctgccatgtcttcagccggtccctccgttccgggtccctgacttcccgcaacagctatttcataatattagggattgtatggctattcagacgtccttcttgagggcaggctctttatcttttcctcacaacagttagcagtgtcatggagatagcaagtattttatagaaaatattgagtgagtccatgaatacgttttaattatttgggtacttaaatgtagaaggttagttgctttaactgtgcttatacaatggaaaccctgttctctgtcaaaaaaaaaaatgtgaagatcttgaaaaatgtggagaaactggggagcagctaagtggctctgaactagtcagattaggctcatctatgctgtagtaacaaacaagcccctaaacctcaatggcaattgatatttatttctcatgtgatctgcctcacaaatcattgcaggaaataatgttaccaatgttttggctcttcataaaacattcattattttctctgtcttttatatagttttctcacccacctctgctcagcccctgtgacaatgtccatctattgcaggtggtggatacaacagcagcccacttatggtatcagtttatgtttcagtcagagtagaataagctatgctgtggaagaaaataaatgctaaaatttcactggcataacaaattaatggttaatttctcaatcatgcaagtccaatgaaagtgtactaggtggcttttctccatcttgtggctgtgccatctgaagaatgtgaccttaagatcaccacacatggaaggaaagacctgaaggaccatgtgaataaagggccagattggtctgtggccatatcacctccactaaatccattgccctcaatccagtcacatgcatcctaacctcaaggaaaactggagaagcacatggatggatacctggtgagaactaatagcatatgccacagattctatagtggcattagaagttcacctaattcttaagtcttgtttttatttattttattatttatttattttttgagatagagtcttcctctgtcacccaggctggagtgcagtgtcacttggctcactgcaactgccacctcccggatttgagcgaccctcccacctcagccttggagtacttaggattacagctgtgagctaccacgcctagctaatttttttggatttttagtagagatgggatttcaccatgttggtaaagttggtcttgaacttctgacctcggtctcccaaagtactgggattacaggtatgagccactgtgccccgccctaatttttaaatttcaaattttaaatttttaaattttaaagtctgatttttaaaataccgaaaggtataccctccaatttctccctaggaatatgccctgtgttagtccagaagatgctgaaggcatatttgaggggttaccatgggggcattctttcatctgatcactgcagatttctccttaactctgtcatgtctcatcagtgtagactgacccacacttttccacaccatttacctctctggattggattgactattctttatctcatttttaacctctcctcatctgtcttcatggagatgtagttttgtgttttaacatctctaagaatatgttttgttaatgtaaattatattttacatatcctctgtactctattttatgtatcatatcctctgttttttaatattatgatgcatactataatgcctcttacatgatctaattatagaattttgacaagtacactattgaaaatcagcctcataattaacagatattactttattttgctgcaattaattgttgcctgctttatcttagcaattatttcttggatggcagaattggataatctgtgttgccacatgggaatatctatgtaaatggcaattaaatacatcctattaaagtatggtgtgaaagagatagatttaagttgggaaataacttccctgtgaccttagagagtttctggattgatcatcagataagtctacaacagatgccaaagaaggtagtatcagtttaagagatttcattcagctaaacacatataataaggaagactatttccaggagctactatgtacattaaattctattagtgatcatcaacaaaatttattaacataaaaataataaagccatctgaagaataattactgcctattgggagaaaaaaatagaaccatgaagaaaataaactctgccaacttagtgattttcgttaagtaaccaaacatttctactttgtgtcttccaaggaaattctttcacttatcaagtgttatacatattctttgttctaaaactgctctattcagctgtcattctatgattttgttttcaaggttgccccttctcttcttactcattttaattcttttctctttgtacttagattaaaataaagtcaattttaggactgtgaggtaagaaaggaagaatttgaaagatgcaacgtccttgtttatagtagatatttcaaagaaaaaatgtaaaattctcgttaatctaagaagactcagagaatatacaagatttaaagaactatctttaataaactattgggtagcattgcacactcagggcttacaactgaaaaaagaatctggcaattttatgcatgaaaaaagcaagagtaaactaatggtctatatagcatttcaggaggtgggacggttctttccaggttcatgtaaagctgaattggggtaatatctctcccctccacaaacatccccactgggccttcacaaagcctgtgaaacagcaaacagttgttttcctaagtaaatcagtatgcagtatcaattttaatgaaatcctttaaaaatatttataagacatactttgtgagctggctcttgaaaagtgattagggattgaatatgtggagagaagatttttcattttgttttatgtttttgaaaactaatgagaacaatgtttgaaaggaagaaggagtaaggtcagcagagtgggaagataaggcaacccaaaactcatcaaagagctaagcaaatggagggcgaggggcattccgtttggcctgttctcttggataatttatgaagttcaagtcacagaactgggaataaactcccaaattttcaggttctgtgacccattcgcttttcactctgctcctctcctgcgaactaaaaagacctcgaattttaaaatataatcaaaaccccccaaaacttaagaaagtgtattctcctttcagccatttaaaataggaaaacaatgaaaagaaagcctcccttaaaatctgaacattcaaagctttcagttaaatttatagatttattcaagaagagttgtcattctattaagttagaagttgactgttgtactgcctcctccaactgtatttgattccagaagtcacagagtatttacactttgtggttcttctttctgtcgctaatccacataagagagatacgtattgtcactctattaaacaacttatttgtggtttgactgtgattttccctgaaccttatatgtgtttcctttcattatggttagaatcttgggcagatggattttttcttatccatccctgcctctgttccacaggcacacaatatcatccttacatatgtaaatcacattaaactggcaagcttccctaccagactggaccctgcagggagcagggtatgtgccatgcttatttctgtgtccctcactaaacctaacacaggatcacacagtagagattcaacagaaatttttgaatatgtattatgttttttaaaccacattgaatttaagtaattgcttattatgaaaacaataactattaattacagatagttgcacaccaaaaagggaaaaagcaatcttttcaaaactgtcgtatgactaaattaaagtcctaatctattttccccttcatgttggtttgtagatgtattctcagatcaaatactattgagattcaggaaagcttgtgtttggcaaggtgaatcattgactgcatagggctggcagccaaaaataaaatagttgattgcaaataaaatgataggctaagaaatctcagcagtgcacttttggggtaagactatggtttgaggagaaatccattgggaaaagtcaacctgggcatgatccaagcaatgaatgcctttagtagactagattcagcaaatgaaactgagtgatttcaaatggaggttcaatgtgaaagtcagagaatggggagagattgagtttatatttttcatttccagccaagttatggattagagtgtttcccaggaagagaagtactagctggggttgagaatcaacttctaggactgaaagaaacttgaaatactaggcaagttttatggtagacagatctaccataaagttaagaatcaaagtggaaactcaattctgtgaacttacccagcacaggatggggacatggaaagccatgattgggagctatacagaaatctgggaattgctgtgatccctcagattgaggtttccaagacaaagaagaattggttaggtggagagaagtggagacacccggcactcatgctgggtcatgctaagttaaaaggaccatggcttcattccaagtctgactcaatggtaaagaaacagttgtaccacttccttagtcaggctttgcacatgaactaggctagagctagagtaaccatcttatctgttttacataccagttctcttttgaatatagaagaaatcaccttaataattatgtctggaccatagtcaaaagcttggattttctaggcagactgagacatattgtcacctagagcatagtctattgaaggtaatgggggctgagtttcagggatctttctgaaaggaccggaggtgatagaagtaggagagattgggttagttttgacaacaattatgtcttatctacatgtgaaggctatttggcattccttaccagaaggcactaatggctaggttaggtgggaaaaagataaagacaccctgccagtggttttctggaggactgtagtggaaccacaggaggaatatgctggaatgaaattcttcacgggcatatccttttggatttcttagtcaatcatgaattagatgatcaggagatgagtgactaagtctataggacgagaagaaagagacccatcaagatgcacagcaactccccatgattagaatcatggaaaactaatgcatatagatcagggtacagaagataagatgacttctcttccccaggaaaatccctaaagtgaccagaataatgtgttttctccagtcttaagaatatatatttagggaaatgacatttgtagattttccaccattgccagtctacatagttgagaagaagcaccaatgttatcatgtattttattcactgaaagaatcacagagattcaatagcttgtgtttccaagcattatgggagactgcttaacaagtccagaaatgctgaataaaatatcacaaacattcttcagatgagattctaaactgctagaaagtaagggacctcaccggagacaaaaaagagagagagagttgaaaacctgaggtacacagcacattcaacatcagactaggctttgagcaagggacaggagagatttgggaatgaggcactgcccataacatcagagcccataaaaagtgacgtgctcagtaaaagggttgacttgaaaaaatttgttcattgccaaaaagataataaagatgtctggactggggtaggtatcaaataaacaaactaaaacgtgtttgagactcttgctatgaatatgacctaatggcatttgccatcttaatttataccaaatcccttgcatgactttgaaccccccaagatgagaaatgaaccgaaaaataatcccaggatggtactacttatctgattcttggccaaagcaagcacaaaatctccctggaggaacaaagttcataggacttctaaacaaatccccctattactcatgtttctaccagtggtcccctgaagaaataaatatgcagcctcaggaacattttatgaattgcaattttaattctggtttgagtccctatcttctttgcataatatctttggctccacaccttcctgtgctatgattgctcaacaaaataaagataatttagaagtggacagagtatgcaggggcttactgaacaacagaaaagtaatatccttctatctatggcttatttttagaatgtgtccttaaatttcagtgtttgtcattatcattcacagagcttatctgtattgacctttactatcctttttaacatcttaaaagcttcaatcatatctctgctcttcaatgtcttttcttcaattgttgtaatctcagtttgtctggctctcagaactaatataaccttctttcccatttatcattctggtcccgtcaatcccttctgcctcctcaatgtctttcctgtgacattattcctttccctgccgagggagattgtctgaaatggtaagtcactgagtgtagattaatcagctaccattacaatgtctggcttcccaagacatgtttgtagcctatttcataaatttgttgttcttaaaagcaaacctaatttcacaatgaaactacccaatccccttttcatcaaaaaccagggtaaaaaatgtctttggtgtaaacaacactgttcagctactgtgatctaattggagttagtttacactgtgccttctctaaaatcattcctcttggaattcttattatagtgagcactgctttgatcccttttagtctctttttgtcctccatttcttccctattttgtcctttctttactccttagagagtgcacattcctgtaacataaagcaagctgttggtaactacccctggtattctgtgcacaataatctttgtgcagtgcttttattcttcacgcttgatgtgtggaacaactctgtgatttctgctaatgcccaaataatagtttcctcaaatgctaaatgccatgctcaagctaagataagacgacagcggtcagaataagagctcaggtcttctgatgcttacttttttcactaaaccaagaaccttaaaactagagatctttttgacaacttaatctagtatggaggtattaccaggttcttgctaaggttgagaaattccctttttgtgaatacaagaactgtatttgtgtgttatttgtatatatttgcataatgatttcaaatgtccaatattcaagtacacaagttgaaatgtagtaaagctactgaagtctacatgattcttttaagaacttccttttagagcatctaggaacatcctcatcatatgactcctgaatttctactttctattttttatttctactttccctatgatctctctttagcaatattccttttttttctcctagcttcatagatatatactatcaacttatatatttatatatttaaattgaatattcaagcaagatgaaaggacttcaattctggtaaggaacttatacaaaactaatcttacatagagttaggggtgggagagaataatagcagaaggataatgttcactaagttactgaccaaagtctgtactaggtatatcacatacccattcccagtagacaccttcccttctaacagtcatgaaaagtagtaatatttcacttattttacaagaagcacaaagagattctgaagataaaatgcaattgttaataaatttaaaaggcaggattgaaacccaagtatgtatgattccaacgctagcgccctttccactgtatcaggctgcgtcatgtgataggcatcaccacatatgacatggtctcaagttgctgagcaggcctgggatcctgatcagtcaaccaacatgcattggactcaacccacatatgggatgctaacggatgagactcaatctttccaatcaagaaacttacaatctcattaggaaaacaagtatagcagatatgatatgattaacaaacattgcatgattacttcataatatgcatatgtggggacagggggtatataagaactcttaactttctgcttagttttgctgtgaatctaaaattgctctaaaaaataaagttagtttaaaaaaatctgtcagagttgagtatttgttggaattcttacaacttccaaaacaagtaccctctcgccaatcagtaatacaacccaatgcatacagaacatcattttaaggcagacagggccaccacatacagcctgtgatctaagcaatttttaagaggactttgtttctcagcaacttcagtgtcggcaggctcccctaagtgttgtctcactcagctggatggcatgtgaaccacaaaatgaagtgcagcagctttgcaggttgacttctgcaagaagtgtgaagaaatatccgtggatttgcaagaagtgttaaaaatatcgcaatcggaatattgtcaatcacttctaaatagatactttctcaggaaacatgtttcctttcttgtttctcactctctcttgtggctgggcaaatgtatagtagtttaaggtgttgcaagaggcaaactccacttaaacctctttatttccctagctgagactttgaagaatagaccataaggagcttggggagttatgtgctatttagttttcttcctgacatcttccttttgacttactgcagattttttttttctcatgccaatatatttttgtatgttggatctcactgaggacaaacaagaaacaggctgtgctaatagaaccaagctaggggatatttcaattcagtgttcagctaatagatttagcataatttatcataggcataatgtacctccgattgtatataaataaaattagtccttatgttgaaaaaaaactgttatagtatatgtgtaccttgcatggaagctaagaacccagtttcacaaatgctgtctcaccccaatgacacattatattgaaaaatccaaataccaagccatgacattcaagtaattttcatgaatttaaatatgctgatcaattactcaaaaaatattccagaggaagactatggggttctgtttgattataaagtgtcagaaatatggatctttaagaaacaaaaatcacccctcaattgcaacaataaatctgaaagtctatggcagaataatttgcagaaaacttaattgggcttccatctcttccttctcttccacaacatagacccaaataggtaatgtgcagttttactgtttcctaaatgtaaattccatactcagattctgttttttttttttcctgtcttaagatgaggatttgaagttggccaaagtgttaatcttctagatcctttccttcaccagcaagaatctgactgtagctgacccttcatgaatgctgcctgatttcatccaccatcacattctctatcagtaggctgcaatttatgagttgttcatagaaaagtgaaggagattaaacaaaaatcctactgatcatcctggctacttccaattaggctgtctccaaattgtgcttcattggggtccagaagaggaaatcaactatacaatcagatatttgggtgtgatagtcacaggagcaaagcatttcctctaaaacacaaaatctgattgtgcaattccctgcttaaattctttcattagcatcatcacccctgttttcttcccaaaccctattatggtatggtttctagttagtttcagtatctaaatctagattcttctgaggcagtggtgctatcatatcatatcatatcatatcatatccttgaaacctggaactcctgggctcaagggatcctccggcctcagccaacctaatagctgggattacaggagtgagccacattgcctgggtcagtatctcaattcttgctgagctttgcctgaaactctgctcctggcacaccaatttctacaggctccttcacaatttcacacctgtttcgtctacctccctgttcctcagccctaaatactggtcaccctgatcttctcctgtccatgttcctaaacttccagttcagcaatcatgcttgactttcctgagcaccttttatctccaggtaaaggtgacccttcttccttgtgccctaattgctgtttttgatcagtgatcattgagccacttaatttgtaaatttcttgaaaatagggacacattcttaagcatcttatccatctccgtacttccaactcttgtaacagtgcctaacacattagaggtagtgaataaatatttctataaacactgttccaatgaaggaataagcaaagaagcagttcatctatagaaagcagagattacgtgagtgtatctagagacagccttttgcatgagtgtaataaggaactgtctcctttacttacacagtatgattttaatagtcttgataaaagtttatctgcataaaagttatcttcttatattttatttcaataatctttcctttttgtaaaggcattagtttcaatcattaaaatgcacaaaataaataataagacagtgctaaaaatgggggaaagtactgaataatggttcaggcaacagggcaaacagaccttgcgtgtacccaccaataatgtaataataataacaataatgacatctagaagactttaaagacagtgacaggaaactcaacaggtgttgtaattaggtcaacatcaaagtagttaagttcacttacactgccaaaagtatcagttttatatgtctggaattctaaagccctaaggggtcaaggaatatggccttacgcccagggcaggtgggagactgaaactgatttggagctgtttaaggatggcccgagtttataaaacagaacatagatgaatctggccaacaagtagaagatgacaaagaagcttgtcatctacctcactgtttgtgaagaagcaatttctcatgagaaactttaactccctgtctgccgttgtgcatggaagtgagatctggatttgctctataccagccaaagctaagaatataatatagatatgagtccaagattcacaaaaccctgggactctagcaaaagcaacttaaaactactctacagggacatttacacaatccagggcacatggcactcaaagagtaaacaactccaaccaaaaatgacttctaacaaaaattacattcccctcgaggaagtaagtcacaataagagagagtcagaagatgcaaaagatgagaaaaatggtgccccaaggacaataaacaataaaactgatatttcacatttttgagattcaacgacattgaatcacatagatacgactaggactttcattgaagaaaaacttgctgtgaagttgaagatgaagttactgtgatacataacatgcctcagtgatttcacaaggcttggcttatcagaggtttgtttgattcaagggaaattgagaaggtatgtgtttcaaaggaataggtcagaaagcttttgcagcaaaagtgcctacttatgatgacctctatgggagtctgttcaggctgctataacaaaatagcttacactgggtggcttataaacaagggaatttatttctcacagttctggaggctgggaaatctaagatcaaaggtctggcaagttcaatatctgatacaagatgacttcctggttcacagcacattcttactgtgtcctcacatgatgggaagtactatctggggcctcttttataagggcactaatcccattcatgagagcactgcaatagcaacctcaaagacattttacaatagtggctgcatgatattggaataagtggaacttcttagtgcccatatttacttttgcctcctcagccctggattaactggatatggcttcagtttgactcttcacatacacatttactcagactaccaagtttttattgattgatttccacgtggctgagtggtgccccagcccttggcctctctaaaataattgttctgggtctatattccctttgctttgctgtcttctatgagtttatgtctgcagggtaagataggaggctatatatatatttttttaaatttaattttatgttttgaaacaaagtctcactgtgtcactcaggctggaatacagtggcacaatcatggctcacggcagcctcaacctcctgggctcaaatgatcctcctgcttcagccccctgtgtaacacacaccgtcacacctggctaatttttgtaatttttagtagagataaggtttcaccatgttacccaggctgctcttgaactcctgaccagcctgagcaagactcaagtgatcctcccactttggcgtcccaaagtgctgggattacaggagtgagccaccgtgagtggccaagggacaggaagatttataaacatcttttgcttaaagttacttctaaagaaaatccatgttccatagaaaagtggatatcaaaacacaggtaaatactatttcctaatagcaacagccaagagatggttcaggaacatcattatgtgtaatcacaacatgcccagagtagtctagataatctgacaatttttgccttaccacacatggctctgatctcaggcaccttttatatttagagagtcagctgctttatcccaattttttcttttcttttcttttctgttctctcctttcctttcctttcctttgtttcttctcttctccctcccctctcctccccatcccctcccctcccttcccttcccttccctttccttcccttttcttcccttctctttctttttttttttctttaagagaagcagtttctctatgttgcccaggctggacttgaacttctgggctcaagtgatcctcccacttcagcctcccaagtagctgggactataggtgcacaccaccgtgcctgactagtttttttgtgtgtgtttattgaagagatggggttccaccatgttgcccaggctggtctcaaactcctgagctcaagctatcctcccaccttggcttcttgagtagctgaaactacaggtgtgtgccaccacacccacctttgacatttttaaaggaaattactcaaacttatctaaaaagaagagataaactgagaggttattaatattctttcttttcatggaaaaaatcccttgtatgtgaattataaatagaattaaactactgccagttatttttttaatgtgcattgcttgatacaaatcatttgtaaaatcattattagcatacatcattaggaaggcattttattattcccaatcataattctttttttttaataatctgctgagagtcacaattcagatcctggagattaggcatgagaagttgggggttggtatgaactttgtggaggacacttaagttgctcctccccagtttctgcttccagacttgagaatggggagtccacttctctctatagataccataaccagttcaaaaaggaacaatgcactgtgctgaagggatcttctttcactagaataagaattccaaaagactaataccccagacactttatattactgtttactgcatttagtcttcagaatattattttttttttcctgcatggtacccaacaatgtcatgttagtgtgtattttcttccatatgttttttagtttctttggaaaccttctagatgctgttttgtttagagtgttttgtaggaaaggaatttacaccatttataatagttagaacaagaaatgtttatatgatgtgaatgaattctctagagagaattttacataactgcttcattttaatttcgtaccttgactcacttttttcctcatttttttattatagacaggataaaatgctagtgaaagatcaaaagctaattaaaagtaatcaagaaattttctttctttacatttatttctaacagcaatttaggctcatatcatttgtaactttttgaaaatcaatgtttagcaaattattaccctgattctcatttagggtttaacgatttccttatagatattgttatatgggagtttatgtgtgttactgaaggcaaccctaatacaattaacaactaagatgcactgaatattctgtattatgaaacatcaactacattaaatctatagtttaacttaaccctcactgtaacactaagaaacaagtattgtcattccattttataggagctatttgcattttggattgctaatttcatttactcaacaagatgttgaccacaaaatataccccaggcactgtgctagactttagaagtttaaataaaaataagtaaaaatcttacacttaagattctcagtttattggcatagaaacaaaatacaatttaagcattctagtataaatttctttgtaaacaactattgggcttagtaacacagcaatttataccattttatctattgcttcaaccaacattaatgatccttacatgcaatggttttcaatcatgtaggtcatgtacctcagctcagaaaaaaagcacatcctcatctccagaatacgcatgtctgtctgtaactagcacagttgcacacgcattgcaaggagacttgaggacccctagaatgtcatctgcacaattctgctcacattttctcccatttctaattcattatctttatttctcttggagtttttttcatgaaaatctgatcatgccacttcctttcataaacactgcaaaggctgttgaggcctatagggtaaaaatataagctcataaccatggtgtatagagggattcatgatctgaatacaactcacctttgcagcctcatcctctatccccatctttccacttatgccatcccacatttgctatgcctattattttttgggaaatttttatagcgattgcatcctttttttttttttttttttttttttcataaaatgccttgcctacaaccctagtctctttactgaactatttactcctactgagccctcagggaatagttcaaagatcacccctctggcctttcaagagagttaatgttccctgctcctgattggctcactttcattatagtacactcagttctccatatccatgggttctgtatccgtgggttcaaccaaccacagacagagggaaaatatttttttaaaaaatggatggttgcatctgtactaaacatatagagacttttttcttgtcattattctctaaataatacagtataatagctatttacatagtatttacattttattatgtattataagtaatctagagacgatttaaagtacacaagaatgtgtgtagattatatgcaaatacgataccatttcatatcagagacttgggcatctgtggatttcagtttccgcggcgggggcgggggtctgaaaccaatcctctatggatatcgtggaacaactgtatttgtaattttgtcttgtaatcattcctgaatcagtgatccagagctgcttttgatcagagactatgcctgttgatatctgcatttcaattatgtattctaacacccggcacatagaaaaaacacagacatatttatttaatttattgatataggcaaaatattctttatctggaaagcaacttcaaagttttgcttttcctcccaaatacgcaactcttcatactacttccaagaagtaatgcctgatctctcagaaagttaatattttgtgataaaaattccgaacacctgtgcaggctgtgtttgatcagatgaccttgtgctgtctggactcaggataactgctcacagacttaaaagtaaggtatgttgagctaaagaagccagagaaatagactttcatggtatgatttgtataaataaatttgaaaacaggcaaaactaatctatggtgatagaggtcagaatagtggttatctctgggggacaatgatctctggtaaggggcttgagtgcgctttcttggatattggaaatgttttataacttgattgaggtgactgttaaatggatgaaaacatatgtaaacattccctgagctactaatgaaatactattagaactataactactactaattttttttataagtaaagctggctctgagactttcactatgatatacatcagcaagaccatcattctgattcagctctagaatgaggaagtggctagtgggcttttaaaaggcttgaaatccatttttgcaaaatttgaggcccaccgaagacccactgaagttcacccatggcccatgcactattaatttttatagatgctgtgatggtttaaaagatgttctcatatccaattctttgaaaggccatctctgaagaataaggtctaatttacctctacttaagtgggggctgcactttgtgacttgctttttttatttaatagataaaagctagtgagaaatgatgaagtgcaacttgggagactgtgaggtactgaggattatgtttcattcactctctcttggatcactggtagtggagaaagttagctgccctgtcatgaagacccctaatggagagggccacatggtgaggtactgagtcctccagcagccagttgtaaatcaacaaagcagtcttccttagaccatgtggttgtgaaaccatgtgactgagcttgcgagcagatttcccagcccagatgctgccttcagctgtctgccgccctagtcaatatctctaccataaccttactggagagcctaagccagagccacctaattaaccagccctggattcttgactctggaaactacgtaagataataaatgtttcttcttttcaactatcaagttttgggataatttgttatgcatcagtagatgtttaatacatatggaaaattaagacccagagaggttaagtcacttgggtgggatcacacatagagtcatacttgagattagaatccagattcctctcctataatgcctcactcctaaaactgttgtaaattttagaagagatatatttgtaaagcattagaaaagttttaatacgtagtgagttgtcaataatgttagattttaacttactatttatccttcagaattgacctctactaattacaacccaatatgaaataaatattagagtttatatcttcaactctagtctcgtcattaagtatgtttcataaaaaaatgaataaagagatcttccatccagtgttcaaaagcctgagactatccactttataggagagctgattgaaaacacaaagcacctctggcagagaggttggcattacactctctgtcgacgctcaaaagcttcaggaagagtttaccatctcagaggaatgagaacaggtatcatagtcagagggcatatatcaccttgggaggtagagaaacagggtttgaggaagctctcaaaaaagaaaggcttgtccttttctttgttatggaaattgtaaggagttgaaggatagagctccagaatattgccattgaacaaatagtaaaagaatagaattaggtactggctaacccatggggcatcagtggcactttcatttcttttatattctttaatttgttattgaaaatgaatctattcttatttaatttgagaaggtggaagtttaggagtggatatttaattgttttacagtgtgagagtatgtacacatttgtgtgtatgtgcatttatagaaccttgtctcaacctacaaataactgaattcagaaagatcacaatctgtgtgaaattgctggtctacttctactcctcagaccttcagtaagttcacagagagagaaaaagatgaaaaagtgtcttttgatgtacaacaaactcttcttcccttccaggtagctttgatttggatttgggttcaaaagagggaatggtggggagaaaaagggaagggaaggaaaagagagagagacgttggaagggaatacaaagaaacgacatattagagcaaattgtaataatacatatctcaattgtagaactttattgagaataccaagctcatttgacataaggcaggcatacattttagaaatctctttcatctaatatatattatccaaattaaaatgtgcttttttaaattcccatggactttattcttaagacacagaaataaacaataaagataacaaatacaccttaatagcaaatccacttaagacatattcttatactccaattttattttatattttatgatattttctaaacaacccctgtggcagttcgaattattgttccactttttaagacttcaaaatttcagaaggtttaaaaagagattaactatttgtagcctacatatgaacacaacttccttctctgtatgacaacattaaatgtgtgtgtgcgttcttcacatacagcctaagttgttcctatcatctagttcacatttggtgaacaaagctgagtagagacaagtagagaccctaccaccagctgatctgctaccaaaagatcagcaacttagactatagaaataatttacaagagacaattttaaaatcccataaagctaagcaatgtagggctttgcgggggaggtcatttctagttgcttaatggcttatcttcaaacattgtcctcagtggggtgccctgctatcttggatctgaaataaatatgctctagccaatttcttgagtatttgtgttgcaaggagcatttgaccaaagatcccatcttcaggcatccctcaggctaaaaaaaaaaagccacagaacaaaccgttaacatttttcttcaattgtcaaatagtttatatacagaatatattttttaaaatttaataaaccagcagcaaaaaggctataacaaaaaaagaagaaaaataaagagagatctgaacactggaccaggcattgcatgtaagaaagtattaaaattggaaataaatatattaaaagggatttgacttttttggttatcagtgtgataaaaattaaaatcccatgagatatcataatatgcaaactacaatggctgacttcttagaacagttgaaaataccaagtattagtgaagatgcaaagacataggaattctcataagatataagtagaaatgtaaatggaaaaaaatcctcttgaaattgtctttcagtgtctcctagaattaaatatgtatttatctgtgaccagtgacttcatttctaagtttacgtagagacaatatgtcaatatttcaatgtgtcaatatgtcatctgtgacaagcatgagaattttgaggacaatactaaaaattagaaatattccaaatgttcattaacattataaatatccatttaaaataaaatactatatagcaatgaaaaagcataaagtactgcttgtgctatagatttcacaagtataatattttgtgaaagaaactaaatacaaaataggacatagctgcataaatttccacatttgtagaaatttcaaagacatgcaaaactaatctctagtatgaaaaaccagaaaaatgactacctctgagttggaaggagagagagcaggagagttgcttctgttttttatcttagcggtggccatatgggtatatttactttgttataactcacctagctatatgcttgtaatttgtgcactattctatacttcaaagttcaaaactcagtggacaatgacaatgattacagtgatagtaactaccatttttgaatgtttcatgcctgtccattacaataaatacaatgaattagtaaattcttataataattttgctagaaacatattattactcccttttgtaaataaagatactgagagtcagaaaaaaaaagatgtaactgagaatcagaggtaacagttcagatctcccagagctgaaaattggcaggaccagaattctaacacgggtttacctgagtccaaatcctatcatttttccttcccggcctcattgttaatagacatgaatttagtttctagtgcatccaatagagcttctaaattgataaaagatcaagctataaactatataaaaccataacatcctttactttactgtagtatagaaaaacaaaatgcacctgggtgttttatgagggaagttattccacctgaaggagaatatgtttgcatggcagcattctttacagagccctcctgccttctcatcagatggctgaccccacctgacctgctaatcagcagggacctacatcctctagagatgttaagccatataagatattggttcagacccgttggattaatgcttagtcaggctgtcttctgggctcagattttctcccaattcatgtttccctttgtggatgttggctccatgctctgtagttcacttcccttgcttcctcacaaccatcccaggctctggaaatcttcctttgacttttttgggagaggattttggactagaactagtaatagtattcatatgctactactagtatttgtggttacttttaatggcaaaaaccacaattacttttgcactaatgtagtacgaagacttataggaagaaattgcttattaaacgtagggtgcctgactgaaatgagcccataaaggaacttggaggtaaaagtgatgaactctcctaagaagcaattgtccttactttaatcagcattcactgtgttaaaattccaccctaggttgatagcacatttctgagtttttgtgaggcaggtaagatgtagtgaaaaaattctgcccacttattgcccatgtgaccttgagaaagctacttggcatttttttgtttgtttgctttttgttttgttttgtttgagatggagttttgctctgtcgcccaggctggagtgcagtggcactatctcagctcactgtaacctccacctcccgggttcaagcagttctcctgcctcagcctcccgagtagctgggactacagatgcacgccgccacactcggctaattttttgtattttagtagaggcagggtttcaccgtgttgcccaggctggtctcgaaccccttagctcaggcaatctgccacctcggcctcccaaagtgctgggattacaggcatgaaccactgtgccccgccgccgcttggcgttttaaacctcagtttcctcatatatagagtgagggtaaggatgtctaattttttgcctctgtaacaatttaatgtctaattcttatctctgtaacaatttaatgagataaagcatgtaaacatgctttggagtattttatgttttcatgagtcaattcaacatgatctgtcaaaagaggttgattgcactttctcctagccaacagatttctagtgaagtgtaccttgattgtatctgaggctgagcattttcttttaaaaagagctttgtaaaaatggcaatattctttatcctttacttaacagcggtaattgaaacagagtttcatgatccattgaaactctgaaaatgatcagcttattctgtgggtgttatagttgtgagttgagttccagttagattttataatatatagaataatattagtattactatcatacctaccattcatggactttatcactattcttatttatttctcaaaacgatcctaggaggtgctttttaatatttacattttacaaaaggagaggaatttggaatcctgcgcaagagaatttaaggaaattgggcagctaatgagagccagaatgggatttatattgagtttgtgtgactctccccacatggagtctatctgcatatcccatcctttgtttgttacaaatctcaataggagtagcatctgaagacttacctgtgtgtatgcagtgtcatgataactagttgagaaataaattattggccagacgcggtggctcacgcctgtaatctcagcactttgggagactaaggtgggtggatcacttgaggtcaggagttcaagaccagcctggccaagatagcgaaactctgtctctacttaaaaaaaaaaagaaaaaaagaacaaacaaacaaacaaaaaaaccccacagaattagccaggagtggtggcacatgcctgtaatcccagtaacttgggaggcgggaggcaggagaatcgtttgaacccaggaggtgaagctagcagcgagccaagatcgtgccattgcacttcagcctgggcaacaagagtgaaactccgtcaaaaaaaaaaaaaaaagagaaagaaagaaagaaattatttagttaatcactaggttattaagtgtacatgtgaccataccataattttgacagatttcatattttattcaaattgaaagtgggtttatatttatattctgacaaaccaatttgattcaacagattattcacgggaataatcaaactagtaatttgatttaagaatagcaataatatatttgatttgaaatgggactcacattttctaaaatcagtgccaaacgtttctcccacagtacacaaatatgcatctacaaatgtctcacagtggctctctttggatctcctgcttctctgtgcctctaccaatccacctatctgggatctttttcctccccagtgattgtgggcattattctcttctcagccaattgttttgacataacctaatagatatttaactgaattcctgaaactcatctcttgttttcccatcaattaccacgatttcagggctaggctagaccagggcttctgaagcattaattatacatatgcatcatctggggatcctattaaaatgtagattcttactcagcagacatagggtggggctcaagcttatgcatttctaatacagttttatgcgatacctttgctactggtccttagaccatactttgagaagcaagggtatacatacaccacattaagtaatagactaattcattataaagaactttgatttgattgctgagaaacctggctttttatcccaacctacaggaattaaccacataagctaattaagtcacaaattccctaggttttcatttcattaagattaaatgtgggctctatctatcttagtcactttccctgctctaacatggaattttcacattaaatataacaccactactagttacactaagttactgagtatctaccatatgccacatattgcaccagaagctacgcctgttatttctttttcatcttcacgaagactccgtaacataaactccatggcatcattttaaaataggagcattggggattacagaataaacgccttttccaaggccacagggtgattggtgctagagccaaaattttacttgaatgatttgtaattttccatttaaaattatattttatatgatttattgtctagtttgtaaaggcatttttgtataagcatatatatttgatcttaatgtcacatatttatttgttaacatcttggccaccactttttcacttaaaaaagctgaaattcagcattaaaaataaaatttgtccaactttaacttcgcctgcataatgagacagagaagatagcctgtgatatttagtgacaaaattaatgaatattaccatcttctttttgcttcagctcacatctttatttttccctattgtttttactttttggatgacaaggcattctccagattcaaaattcaaagctcatttaaagagtatttaataaaaagaatccctctaaatcctgtccctgagccacgagctgctcctctccagaggcaaccaatattcgactttaaattcatcctgaaataccttatgcttatataagcaaatctttttctttttttatctattcatgtgactctatatttttacatgaggagctagccgttaaacccaggtctcttttcatcaaaggtccacgctttcaaactttacaacataaaccctctttcttatgaatacgctatttgtgtgtagatactgtattacaaaacaaaaatacttaggtccaaagagtgcctgtgacatgaactccactcgttgcttcagtcctgggtcgatgggatgcaaggccctgccagaacagagagtaggcagactgtacccctcccttcttagcacactgctcacaagcaggtgggcacagagtctgcaacagcagaggctgcacaactcaaggaagtgattctgcccaactcccacatgacaaccacaccaaacctcgagtaccatggctcagcagtctacaccatgaagactatggcgaagactttgaggtccttttctcacaaaagttaagagtatcattctcaactgaatgaaaagtaccatatattttctaaaccaccaacaaatgcatttgatttaccaataaataaaatattattatagtggtatttattttttcactcaagtatcaaagctactcagtgcatgagtttaaacaagttaaattttgaactacatttatgttgaattttaactcaaaacacaggaaaacaataaacaatgccagataaggttgaattaacaagccagctgatttatttttctagcttctggggccagttgctggtggctttgttcattctataggtttgcaagtatgatatacttcactaagcaggatctggtttgtatatcttttattttttctgatataacctcttctacaaaatagcaaagtaacattgggccagttccttaatggccaactttctgtggtcattcttttcagcatgtgtaatacaaggtgcttaaagtatggatttcctttataaggaagtaagaaaccccgagaaaagagagattttgtctccatcacaaaaacaaaacaatgagtgaataatttttttaaatcagtcaattcaagtggtacatattgcatgaatccaagtgtttaattaatattttcatcatcagcccaatgaccttcaaatcttttattaaaaatacctgtaaattcacagtcaaacccagaattttattacccatttcaaaattccacttctcaatataacattattatagagggaagcactagacagagattgcaaagtcagtccagaaaaacaaaggtaaaatgaaatggacttttaaaactctgcagatacagttccatctggaaagccatcacatacaactgtccaagtggaaaaaaaaaaataaaaaaggactgagcactccctactcatataagataaaagaaaattctttttctaccctaagattctgaaattgcattttgctatttccttccaatgttagaacagtgtgatccagtattggtggcatgtatgctagcagagtggaaaaaaaaaccctccaatctcacactcgggaagctgatgctgacaacatttttggcagatggactgtgattttctctcctgtgaaaccaaacattccaattaaaatggttctctgatttttgagcaatgataaaagaaaaaagaagctacatgaggagcagacagaaaagttaaacctaaaaaagagcaaaaaggaaagagagataaagacaggtgagaaatatatatcagaaataaatgtgaaagctatacaacagataatcagttggaaaaggagtaaaaggagaaatgtaggctgaagattatttaaatagaagcaatgtagtagaagcagtgatatatggcaaaagtcagtctacaatacatgaagtttatttactctggaatacacaaatttctcatttcactagctgttttaagcccagttgtttggtagtgtgtgttgaagttttcattttaggaccaaaaaaaaaaaaaaaaaacccctcttcttttattttatggatttattgtgtggttctctcagctattcaataatcatgaattaaacactttgtgtatgccattgactctgtggtagaattcgcagtacatatgtgtttgccagggaaaaagtgtgtgtgtgtgtgcatgcacacgcacacatgtgtaggcatgtaaagaatatcttaaaatcaacatatttttcttgattttctaggttaactaggagttctcagtgctctatgtgtccccttgaaacaggtattccatgccttgatggctaataactctcaagataattgaccaacttcatgggtaaatagcagggaagaagttagccagaatctgattcctcctgggagagaatgctgaattgttgtactgtagacttaattattctgggaaacacatttctaggaatccctttcctaaatgattttctttatttctagggttagagtcgatcaaaagtaaagttgggtgggactggtgagatgaagtgaagtatcagacgtcgtgttctgaaattcccattagttagtggtggtgagagacttacagggaggttttggtgggttcccgtatcttcactcttccattctccactaccagatctccttcccaattgccatcctgaccaacaatgattggtctcagatccaacaccagacacatggctgcaaactcgtagaggcagaagccacgaagcaccaaaggctttcatggacttcttcatgtgtgatttgacacaggatgaaatagaattaaagggcaactacttctttaaatactggaaggctgtgaccatggttaaggatagcacatctgcatttccatctatttgtttacaattaaaagaagaaaatagtatttttattagcagtgcaatcccctttccagtgcttacctttccctgtctctgccccttgcacactaagggaaagatatgaatgaataatttgataaactgcttgggacagggcctgaaagcctccaagtcgagcctgtgtcatgcaactggctgctaacatgtcttctggagaatggagcttcaactaattgaaggacctttgttttgtttaggggatattgtatttggaaaccattaaaatgctaagacaataggggatattgaaaataacatttttgaagaaatgcaatgaaaataaggaaggtctcttagagaaacataatggaggaacagaaatgtcgaatacagattttattaagttgtttgcagtattctatcagatatgacctctctttttttccatggaaaccggtaaaatctacatttctcactctttggtggtgtagatttactttatcaatgtgaaatttgcagtgaatacaaggatggataaacaactcttgagtgcttatccaggcactgctccagctgggaatatggtgttgaccaagatggccacatctccctgtcagtcttacaaccctgaagactatgaatggagacaacaatattaacagctcacagtgcaggcataaaacaagtgttattaaaggaaatagggaagaaaatcaagagaatgcacctagtcccacaagctcttaccagcccactgagaagtgtgcttgatcacatcaccatgaaacattccatgattgtgatcctagaaagggaactcatctctgtgcttctttacttatttacaggaaacttggaaagagtcaggaagcataaagccagcaatcaggtaactggggagatgtttggcctgtgaaacaatttgctagaaaaacaaatatccggggcttgaacctacaaacagattcactggagttaaattcagagggatatattatgatgtccaactgcacagtggacctaaccactaggtgattatgaaagtcccctatattaactatggaaatttggcttcagtactacctagacaaatggtgcttttccatgggtagaaccttgccaagatcttcacaaagccattttcacagtttcctcttgggaaacaacggtaatcctaataataacgtaaaagatctctttatgaaaaaaaggtttctgtctaataggacaggtcattctagcaaatagtaaaatctggggaaaacatacaaagaacagtaactcacctagatttgaaaagtggggatgggcacgttttacatttattctaattgtaagcaaaagttgcgggacatctggtactatggaaacagtgacagatgctagtaaagttgtgctgtgattataaattgtattttcatattgaagacctctaggtgtttacatacgctggtagagttcagtttcactgcagggatctcagaagtagggtgaggcattaagccctgaatattttaattggtctcaatatactaattggtctgaaaatgacagttatgtaaaaatctcagggtcagagatctgcattatttactggtgaaacaagttttcaattctttaactagaataaagaaatgagtatttgctgagtgacttgcttgcagaaaagttgagataaattcataaataaatctattacaaagcctgactgaaaacgaatggcttactttacacattaggacttaaaatgcagcactccatatgggaaaggcattcttaatctcttcattgttatttaatttaacatgtggagcaacaggttcattaatcacttcatattaatattcaagtgagagtgaagatgctgggacacgttctattccaaatagcgattctatttggctgggcgttgtcttaggcatgatggagagggaacaggaaggaagattaactttctgctacacttatttctgcttcattatcctggaagtcttttatgaaccattagtaatacttaaccagggtaaagccaatcttgatgtctgcccaatttaataaacaaaacctctttaatttaaagcttatgtgttggccagacacggtggttcacacctgtaatcccagcattttgacagtccgaggtgggtggatcacctgaggtagggagttcaagaccagcctgaccaacatggagaaatcccatgtctactaaaaatacaaaattagccgggcgtggtcgtgcatgcctataaacccagctactcaggaggctgaggcaggagaatcgcttgaacctggggggcggaggttgcagtgagctgagatcgcgccactgcactccagcccagtaacagagtgagactctgtctcaaaaataaataaataaataaataaataaataaataaataaacttatatgcttgtttattcaaaacagtcatatttacaaatcatgataagaaagaatgatcatttatttcatcctacattttctctcatctttggaggcatatggtagctaataagaaaagaaaagaaaagaaaaactactatttattgagatcttgagctaggcctttgctttttatttgcattgttatctaataagttaacatacatgtgaaaaaaaaatcttctcttctaatatactctctgaaaactggaatacatatagtgaaacataagaaaaggattatataacttacaatagttaggttgcctgttgaaagtttagattgttattggtgaatattaagcattatgaaatattaatggtaatgtgttgtaagctttagaaagttaatcttatttaattctcatgatggctctatgaggtaaatatttttattcctatttaatagtcaaggcagctgaggtttagagatgttaagtaatttgcccaaggtcacacaactaataagtgttagaggtgaaaaataaaatgcaatgcttgtgctcttatacatgcaaaaaattgcataagtagtctcttcagtaaatttactatgcagcatttagtagcctgtaacctaaaaaagtaagaatatgctgtgcttaaagtccaagaattttccaagacctctttggttgttcggtgaagcctggagaaccccctcaagtatatctaaggctagttaatagctcaaacaggatcatattcacataatgcaggctttatcttttgctgccttgttaagattcagtttgagcagccttccaggttaggggaggttgtcattggttcttgccttgacctgacatatagccatcgttcatttccaggatgaatttctgttctgtattaatgaacaaggtgcagaacatgaaatacaggactcattacatttcttggttttcttcaagatctttgcttacttctggcttaaatcaaatgaaattgttttcctgggtcttggtgaccctctaaaataaggagactctttgggaagctcagttggcagtctgggttgtacagaacttttagctcactcctgcctctcattttcatcacagaagatcctcaccttttgagcatcttattcaatacaatttgagttatgggaactttttaattaccctttctggaaccctttgtttgaaatcttcattttagttttcagaagataatgcaatcaaaactggacttattttattttaaatatcttcctaagtcccttctttttagtaacaccaatactagttatgctttttagcttcttctgccctctaggtagaaggtgtcatccaattatgtcgctacaagtttccttatgtctctttccttataagttaaaatctcattagattttatgaaaagtttcagtaatatgcagtgtattgcaattacgagccttggcgtctgtcttaatatgatcttgctcgaactttgaaaatacttattcatagctgtttgcctcattatgcaccaagctaaagcttgctaaaactgaaaccattttcatgcctccacgatgtcatggaaggaagtgaggatctcctagtagatttccttttttccttctaaagcagtcaagagcacagcaagatgttgctgaaggtatttaaaggaaaatgaggtcatggtgtcaccagaaaaggtcactgggctggcttccgtgagtcttcacatctgacactcagctcctcaggctcagaagctcagtcttgacaggggtaacccagatttgattagatctgaatatggagttacattacacttctcatgaaataattttcaaaacaagaatgacaagaaattaatttgcaatgaggtagataactgccagtggaatcagacactcacatcttctggtagatattctcttcttgtaacatagtaaatgaaagccaaatcatggtcaaaagttgcttagcattttaacaggtgcatcattatgatttgaatacttaagaccctcaagatagcacaacctgatgcatttatgtaaaatgtgcttgttactaagaccatataggctgaatccttgattaggcctccttctcccagggcactgcttaaacagacattgccagtactcccatgttctagtactaaccaatccattcttctgccctacaattgatttaaaaagtagaactttttgggaccattatattttaagtggtttttgttaaaaggactattgtatcttaaagtgactctgacctcatccgtaaggtgttcatttgtagttattcctcttaagagtaattttatttccccatttcaccacgttcacctccaattcagtgcatgatggtgcactggaaagagtttatcacaacaggagtcatgaggccaactccaagagacaaggaatacatatacaaggacacacacttggtacggtcagacaaataacaggatgtttcactttgtattaaattaacttgggataattcccaagatccaaggtagatctcaaaaatgaaccttctaggaaagaacaaaagcatctactggaacctggcaggaatttcagggacgcttgttctagaactcaagataaactttaaaatggaagtacaaaaacaattctttttaggaaaagaattgttaagtgaatcttaaggcatcagagcatgatgcttatgatcatgagttttagggtcaaccagagctggctctgccacgtcttaactgtgcgaatttgattagcttcaataaccggagcctgtttttctttatctgcaagactggggaaataagaatgcctacctcacaagggcaggagggttaaaaaaggcagttcatgaaaagattgaattcagtatgtgtactgcagacagcactcagtaagtgaaagttgctatttattggattaaagggttggttttattttatttaagaaggattatcaattgagggcttcagagcaacactgtactttatttacaaaataaaaatatgcaattgggaattagtttcagccattacgaactacgaaatattgtgtacatatatatacatatatatgtgtatataatgcctgtatgtatatatatattatgtttatgagcatatacgatacttaattgtgaaatgctccttaactgattgtgaagcaggtttattgcgcactgtttgttgtttattgtgcactggctcccagcttgtctgagtctggtgagacaaaacacactcatatgcaacaagttatatgaagtggattcatttcttacagataggcagcaagagacagcagatatcaaggattcattgtgaaacagtccccccaggttcagaaaactaccaagagagatggagtctcaagtccactggcaccatttatactgctgaagagggatcctgaaaggcagccaaccctaggttatataacttgtggtcacaggaatcacggggctaaagcactgtggacatcctctttttaggtgggaggactggaatggaggccagactgccccatctagttcctccctatctcagggcattgcattcccagcacattctacaattattcttgagaactacaagtgagaaaaggggaagaacagagcaggtccaaggtcacacagagaactgcctagttgcaacaaacacgtatgccacagaaatgaagcagtttaagggacggcctccagaacctgaacgcatgcttttcagtgctgtcttcttcccttactggctgtatggacttgggcaacttatgcggtctctttggacatataaaaggcttgtatttaccctctacgtttctagatttgaaccctgtaaaatgatcaccaggtaggaaaagagtcacagttatataagaacattcagaattacattctctagtaatctaaattaatcttatctctatttgatagttttctggttctctcactatacttgggcatggatctcaacaaaaaatactgcctctctgggcacatgatttttgttctttacaataagatatagcataatggctgacttcaattcattttccagctatgccttattgagtttgtgaccttggacaaacttctcaaaaccttgattttctttttagtaaaatggttataataataatgaccctttcataaggtttttgtaagaagtaaatggtgtaatgcatataaaacattgaatacatatttgacctggaggaaatattcaatgaattctattttttattttagtacagaacatacaacagtgattgtaaacagtattgagtatggaaggagaatgtgtagtgtaaaaaaaaaatcctccatttagtaataaattattttatctggggaaaaaaatcaggtatattttaagggcaatagaagctacaaaaagtagtcaggtagaaagggggaactcttggctgaaggacacatataaaaggatgcagagacattaaaaggtgaagatgtcaccctagaagtgagtgttacagaatctcaaaaaaaatattttgataatatcacaaaagaggatgagtttctgtttttactaaaaaaaatgattccaatggtcaggtaagataagatttacaaataatggaatatctttattaacccatggaactaatgcaaagttcatttttattttagataaagtgcctattttacatagatttcctcttaacagagaacgtccatcgggatcttttcatgaacagatagcttagcaagcttagctgggcctgttgtagaacttgttgattaaatgactgggaatcctaaaagggttggggtagtgtctccgcatggtcagaggtgtcagtgacatctaccctctttttcttttcttttttttttgttacttaatttaagcagcatccctctgcttttctttgtctttattaattgtcctttgaaagatggtaaatatatggcttctccagttgtggtctttggtgctccttcagagaaggctggtatttaccctctagctttcccgatttgaactacgtcaaataatgaccttgccccacccagctctttttcttttttggagaggttgtcaccatgagcccctttggaaaaaaatccatctttctctattattgggggaaagaacactgaagaaacaagactttattcccatgaaaaatttacaaagaaaatcaagaattttttaaaaaatttgaatactttctaatcaaatgtactatacacatcaggaaaaggaaaaattaaactggatctattaggttggtgcacaagtaattgcagtttttgccattaaaagtaatgatacaagtaatttgccgttacaaaaactgtaattacttgtgaaccaacctaataagagtcttagagaagatctaataaaggaagcaaaacttaacttctactttgaaagattaaaaaatgctaacccattatactttgagttcttaagatgttaggatgtgtctggatggtactaagtacttatttttatttttttaaaataatttcaacttgtgttttagattcgagggggtacatgtttaggtttggaaaactacaaagcctctttgatatggatgaggggtccccaacccccaggccatggaccagaactggtctttggcctgttgggaactgggtcacacagtaagaggtgagtggtgaacaagcgagcaaactttcatctgtatttatagccactccccatcacttgcattactgcctgagctccacttcctgtcagatcagcagcggcattagattctcataggagtgtggaccctattatgaactgtgcatgtgaaggatctaggttgtgagctccttatgagaatctaatgcctgatgatctgaggtagaactgaggcagtgatgcttgcccagaggaatggctgcaaatacagattaacattagcaaagagctttgacttcacagagaccataataaatcatttgcttgcagactgttctagttcattttcatgctgctatgaagaaatacccaagactcggtaatttataaaggaaagaggtttaattgactcacagtttcacatggctatggaggcctcaggaaacttacaatcatggtggaaggggaagcaaacacgtccttcttcacatggcaacaggagagagaagtgctcagcggagggggagaaaaacctttataaagccatcatattccaagaaaactcactcactatcacaagaacagcataggggaacacccccatgatcgaaatcacctcccacaaggtccctcccccaacacgtgggtattacaatttgaattacaattcaagatgagatgtgggtgggaacacagagccagatcatatcacagactcatatcaaaacccttttagtaggtggcaggtaacaattaagctgcccctggtggcaggctttatagtgccaagtgagttcaggtacttcaattgtatagctacatctcatggcaggctttatgtcagaatctgacatttattttagtttgcacatggcccacccattattttacttaccactttcatgtacatctcttttttccactgtgcactcatctccagcacgcttttggtaagcccacaagctaaccctagccaaaatgggtatagaacaaacatcactggagatcttccttgcaaagggagaaagaccaaataatgagagagcagaagactctaagactgccaacaaaaagaaagctgcatttaaaggaaaataccaagggtcctacataaattacacgttcattacaatagttgattcacattctccaagcccactttgtataatatgtggggactagctatccaacaaagctgtgaactctttaaaacggcttcgccacatggaaaccaagcaccctgtattaaatcacaagactttggagtttttcaaaagaaataaacatgaaaacagagaacagaagcaattatcgaaggccaccatttcatcaaatgtgtctgcactgagagcatcattcttaatggctaaccacattgctaaagtaaagaagtcctttactattggtgaagagttgatcctgcctcctggtaataatatttgttgttaacttttaggagaggctgcaggtcaaaaggtggcacatgttcctcttttggctggcaccgtaactagatgaattgatgaaatggcagaggatattgaggcacaattgctaaagaggatgaatgagccactgtagtattcaatccaggttgatgagtctacccatgttgacaacaggtaacaatgcttgtttttgtgcaatgtggcttttaggaggatgtgcgtgaggataagtcatgtgcattttgttttgccaaccaacactacagctgcacaactattcaagtctttgaataattatgtatcaggacaactgaattggtcatatcgtgtcggtgcgtgcatggatggagcagctgtcatggctgcgtggctttctggtttcactgcttgggtcaaagaggttgcttctgaatatgagtctacgcactgtgtccttcatagagaaatgctggctagccaaaaaaacgtcagcagaacttaacaacattttgcaggatgtgattttaaaattaacaaccacgttaacgtacatgcccttaactcacgtctgttcatgcagctctgtgaggagatggacacagagcaaacacatctctcagacacagaagtgagatggctttctatacgtagatccctggccagagattttgagttatgagagccacttcagaaatagcacatttcaatgacacagaatgggatacaaaacttgcttacttatgtgacatattcaacctgctcaacgaactcaatctgtcgcttcagtggagaatgaccactgtgttcaagttggcagataaagtggctgcattcaaagacaaactggaattatggggcaacaagtgaacatcaggatttctggcatgtttgaaacattagcagagattttggaagagatggagccagaggcttctttctcccagcttgtgcatgatcacctaattcagcttacaaaagaatttgagcattacttcccaaccacagaacacccccagactgggaaggaatggatccgtgatccatttgtgaataagccaagtgaatcgactttgtctgtgctagaagaggatcaactgctcgagatcacaaatgatggtggccttaaaaggtatgtttgagacaacttcaaatcctaatcatcaaggtcaaataggtgtgacaaaagcatccaaaagcctgcttccatttccaacatcctatcttggtgaagcagggttttctgcagtgacagcaaccaaaatgagattacggagtagactggacataagcaacataagcaacacatttcgggtgtcactgtctaccatcacccacagatgggaccatctagttgcaggaaaacaagctcagggctcccactgactctacattatggtgagttatatatttatttcattattatatattacaatgtaataataatagtataaagtgcacaataaatgtaatgtactagaatcatcccaaaaccatctccccaacccctggtccatggaaaaagttgtcttccatgaaaccagtccctggtgccaaaaaggttggggactgctggtatagattatattactgcctggattttacagacaaggaaattgaagcttattattgtaacttgtgtctaaagcttgtgaatagaggagcaggcttttgaacttggacattttgtatttagccacctattcctaacatctcccttatactactagagagaaggcaagtggtttctttgctgttcaggtatatgccaggttcaacagttcccaatgttacctctttatgaaacaacaatggcaaccaaaacaaaaaccttatgccacaattattctgtcatctggatgttgttgtattcttccatgctaaaagggtagctttgtgatataagttggaattttgtagcttgcctttacttgtacactcaatgaccctgaatcagaagaagtagctatcaaaggtttgagagttatctgtgccaatgatataatgcttttcttcaaggtacattcattcatcagatatgtattgaatcccataatgggaagggcattataaagttgggtgggcatagggagaaatatttgatgtagtttctactcacaaagacctcatagccatttgggacagcagaccacaaatgaataaattacaacctagcatagtgtgtgccgtaatgtaagctgctagatactttttttcttacttcaacttattgcagaactaaaaccaatatcttcattttggctctgacttggaataaatcttactctgcctcctgggacagtgaaagctctgttgagaaactaataagttcggcccaaattctcagcagtgtgcttgatgaaaaataacaaattttgagaagaagaaaagaagtaaggcagttcagcttactagaacttgatccaaatattcagagaaaaattcaggctttggttatctaaacaagcaggtggagacagttaagaaattagcataagttaaataatgaaacattcattatttcacaattgaattactaaaatccttggcataaacatacttctatgtcacatgctattttattgttgctaatagaaaacagtcatgtataatttagagagatactttaattagaatatcaattatttccaaatatataaaaataataacaaatagacaagggcatctttagagccctaaatttcagcagcactgtatgtttagtggaatgtgacactttagaatgagttttcagacattccaatatatttctgtactttggatttttatagagtggaatgccttggtcattttttagagttttgatagtatattcagtattcttgcaaactacggataaagtaaatgactgttcaaatatttgacaagcactttataaagaaaaatatgaatgatataaaatagagaatatagtataatgaaaaggcacagcaaataccttctgttatatacactcatatttctcagtctctataacgatcctctaagatattatgcaatattgggagacagatgaattgacaagagatagtgaaaacgatatttataatggcatcaccagcagagcaggaaaagccacagagcagagcagatggggaataaagttctttgttctattcggtggacttccattcacaatttttcccataatttgtaggtggacctcattcagcctgcagcttccctctaatcatgggaggcagagtagcaaattggacaagctctctgtgaattccaaaagctttggatctgaactctggccctgccttttactaacttggggattttggacaatcagtttcatccttcttttacaaaatgagaaaaatgacgtatgcataattcctatcattgttgtaaggattaaatttgatgacatatgccatgacaagatttttctccctactttaccagctactcaagccctaaaccagctgtctccaatttctcatctttgctcaatgtcctcatgtaatccacaggaaagtccaactaactctgcttccaagacaaatcttgtatctgttcatttttctccatcttccctgataccttctacaccaggaattcttaatcttggaactattgacatttggagtcatgatcagctacataattcacaagacccattgcgaaatgaaagtgtagggtatcttgttcaaaatgaaggaaaaatatgaccctaaaggtactaaagtgtcacgacttttcctttcctctgcagtctctctcttgacttgtcatcaggttaatttgctattcaaatataattctaagttttaaaaaatgttaaattactagcatgaatgttatcactcatctttatattatacaatgccagctttaaatgcaaatatatgactatttaacttgcatgcagaatcgccaaaattatacaattagtatttcatagcttgtgtatgtatatgtattttgttcttaccagaacagtagaaacactgcacaaaactaattcaactgctttcatttaacttcctgatgtgtgcatattctaaattcactctgattaagaaagaagaaaaaggaaaaggaaacaaggcttatcctatctttcttccactttccttcaatattattattttcatagtaagtagttggctaacacagagaagtaacaagtaagaaaggatacataaggttcctaagcatgtgtgtttcttcgaaagccttggcctactttctccattggaagccatttcaagcagaaaacatagatacttgaggcctccggtcctgcttactcaatcacagatgtaacatagtgacattgaactcactgtgagccttgtagaaatcccacagaccatagatccgctggaattctgtgctcattgtttatggccaacagtgaacggcggacacacacaatgcccctgtctctatggcatacaggcatgctttattgtcccaaaggatttcacttacaaatcataagttccatgataataatttttatgaaatgtcaagatgacaatagcatcacgataaatctagtgtggcatctttgagtgtgggtgggaccctgtggagtcatgaagccatgaagctgtccccgttaacatgggaaaattctttttgtggggggctcttctgcacaccatatgatgtttagaaccattcctggcctctacccactagatgctagcagcagtgaccaaaggtgaatatttaaggagagaaatgttacaactccaatgtctctttggccatttttaatactggaatagtcaaagatctggagaaagaaggctgctgggaatcagagtgccccactctctacttatgtccagatgataaattaaaatggaaatgacattaccaaaaaaaactttaataacaagaaaagaagaaataaaagcccttaagaaattaatcaataaagacttcagaataggaaacatcaagatgattttaaaatgatttagtcaaacatttgccaagtgtgaaaaaagtcactcaaacggattgattagctgaatttatttaagacagttgagctcatctcctcttagacacaatctaaagatccattatacactcatgttttttaatagattcatttatattttattgatacataataactgtacatagttatggggcacatatattctgatacatgcatacaaagtgtaataatcaaaccaggtatttagggtatctatcacctcaaacatttatcatttctttgtgttgggaaatttcaagtagtctcttctaactattttgaaatattcatgaagttattcctaataatagtctctctactgtgctatagaacactaaaacttatttcttcagtctaacagttgcacgtttatgcctattaaccacctcttcatcatccttagcccttcacacactttctagactccagtgtctaacattctactctccagctgcatgagatccatttttttagttgccatatatgagtgagaacatgagctatccatccttatgtgcctggcttacttcacttaacataatgacctccagttccatccatgttgctgcaaatgaaaggatttcattctttttttgtggctgaatggtattccattgtgtatatatgccacattttctttatccattcatctgttgatgaacacttagactgattccatatcttggctattgtaagtagtgctacaataaacatgggattgcagattatatattcatttacaagacaaaatatacttggccccctttatttgtaacatatatacctgaaattttcatgtgaaaggtatgggatttaagagaaaggtgtgtgattatcttttctaggagttagtgacagtttggcaaataagtttttcatctagactactgacttatttatatcctttggatttgaaagaagattcaaatagtagatgacttcacaggtaaattcttttttttttttcattttttttctacatttgtctccctccctacttcttctctgaaattagcatatatttattaaacactactgtcaggtagggcatgagtgcgaaatattttataagacatagtccctaccctcaaggaatttactgtctagctatgattcatgtttttgttatttcactagttttctcctcaatcatctgtcactatcatcactcctattatcatctcatgaatatcctaatttccctttagcactatattataaacctattggaccaatttatctcaactcttttaaaactttcacttagtagtctccaagaaatttcaggacttgagaataatgaaaattaatatctttaaatttgcaacgtgccttttctttcactgcaaaagcaaacagtgcacaattttcgaatgacttcaaagtgcaaatgggaaagctgcaattgtaatgaggaaaaagaaatcaaataggattcaaatattgtcaagtaagccttcatcgtggtgggggtcttggtgtctttgtggtgattgaaatacttgacagaaaattgaaagaaaaaaaacagaaaatgtgattgagaattgatttaagagggtgacaaactcaacaggacttctaagtcatcttatgtaaaatgctgtggaagacagtgaccacttcctctcactgacaggcggttccctgtgctgtcaatgagcttccctcaaggctggattaaatacactctgggaacttttgaattaggcaggagaacctgctcagtaatttagagaatttagcactaataaagactaagatgattgtacataatgggattgtaggattttagcaatcctggtttagatgacaaatgctaccacgtaaagcgttttatgacaacatatgttataagagattatacttattccctgtggagctttttcacctccattttagctactcttagaatctgtactgaataagggaaataattgaggctgtgaaatttgattcttttcaaacactatggggaaaatgttaaataaatctgcataaaagacatccacaacataaagttgagaagcttagcttacgtgttaatcattgctttgtgctgtttgcaaaacaaccaccaaatttggcccaagacaaagaatattgcctcattaacaaatttggcaacgctacagtgacagtaatcacatttttattctattttcatattcgagacttcaaagcagcttaaaaaatattcattaacaaagcaggttgcagcatgccaaccagtagctgcatcagcatagtcagatataattttgtgagctttacctaggagggcagagtttagctatagccacaggaaatatacacacacaaagaaacatgttagataagattaatgaaaatgttctcttaaaaataaatgagtttctcaatgaaaggggaaaaaatcctgcaacataatttgtcctttggattttaagtggtgtggtcaatcattaatgagaaacataatttaagaaactttacaaagactgaattgttgctaaatacaaatatataaaatggtgaggaaatatacaaaatgtgccaagtttttcaaacggattcaaaaaattatcaagtacattaaaacatttaattacaaaagtaaaaaatgcagtaatatgaatgaaacaatgagagaaatcaatttcaaaacccagtgcgatgcggatgtggtggaattgtatgcattcgtattgaaaagggtatgaaagtgagaaaatcagaaactggtgtctcaaagaagattgaggcaaagggctagactggagcaaggacacgaactagcagctgtcttaagtcagtacttgcttatctttctgatgccagtgtgactgcaagtgtgacccaggttacctaggtttgtgtactcaatcccatatgtctgaaatgaagccaatcttacctgtatattttgtgggtgatgcattcatctatacacataaacatgaagatctaggaaatgatttattttggcttccaaattaaaccagaagtgccaatgtagaggaggatcagtagcccactgtgctcttgataatgggtgatgtgcctcactcataggtctggccattggctggggcaatgggagctattggggtcccatgtggccaacatctggtagatatcttaggtttcctcagataatattcagatgccaaaaaatcatggtcctttagtacatttgttgtaactgattacattgaatccactctgagccatttgaacaccttatctaccatttacctatctatcacctatctttacctatctgtctgtctgtctgtctatctatctatctatctatctatctatctatcatatctctctgtctgtctgtctatctatctatccatctatctatcctatctatctaagtatctatctatgtatcatctatctatctatctgtctgtctgtctgtctgtctatctatctatctatctatctatctatctatctatctatctatgctatctataaactaacaggtttagttagtgaaatgaattaataagacctgaggaataattatgtgacctagactagggtcacattagattatagagatcatgaaacaagttgtttgcatcattggatatgactgtttctcaaagtttttctaatgtcacagttggtactggaaatgttctttcctcgggtgaattcaaagagacaccagagatcttaacagtccatagtgtatatgctgagagcaaataaactgagtcagtaatatacataatgatcatcaaaatccaaacattgaccagatagctcaaggtgttctaaagctataataggcatgtaacacattttctgtcctgcaacaagtatgtaagtatgtgtgtttatatgcatgtttgttttaaaaagtgtatctttttaaataaaagacttggagtcatttataagtaatgcatataatgaaataaaaataaataaataataaaatgaatgccatttgatctagcaatcccactactaggtatctacccaaaggaaaataagccattatatgaaaaagacacacacatatgcttatagaagcacaattagcatttgcaaaaatatggaaccaaattgaatgcctatcagccaacaggtggataaagaaaatatggtatatatacaccataaaacactactcagccataaaacagaatgaaataatggcatttgcagcaagttggatggagctggaggccattattctaagtgaaataactcaggaatagaaaacaaagtagtgtatattctcacttataagtgggagctaagctatggggatgtaaaggcataagaataatgtaatggactttggggactatggaagaagaagaaaggtgggaagggtgggaggggaggtgagggctaaatgactaaatatcaggtataactgggtgcagtgtacactgctcaggggacaggtgcacctaaatctctaaaatcaccgctaaagaacttatccatgtaaacagaaaacccctgtaccccaaaaacaattaaataaaaaaatatgaatgcaggcagagatatctacctcataatctaatgccaagactactggctaaatataaatacataaatttattttgtctaaaaaaaagagaatgcctaaaatataatgaagccaagactaggaaaaatatgaatgaaataaaatgctaagtaaaagaaaggagaaaaaaacaaatcttatatgaaggatgccaagcattcacaatttctatagtttactttcctgatgtctaaagctaaaagagaaaaaccagctctattgggctattcagttgtaaaatgtcaaatttcattcttacatccattctgagaaaagaaaggcaagttcttacttccaaaactgtaagtgaaagaaatgcaagcacagaaaaatcagatgccaaatacagaatcacacaattgcttattgaaagatttgggattaagaccaagcatatcagttcctggccaagtgtatgtttcctaatctcccaggttagctaggccagtagctactacgcattatctggggttagaggagactggttttgcttcccaaatggcaagtgatacagcaatggacaatgacacaagagctctgtgctcgtgtttcttatagtctgtagtcacaggatcacacatggcacccagagaacactcgggactcaacaagtgtttgttgattaattaaatacagtttgcctcctacagcattcgtgatttccagtacaaattaacagagtagaacgccgtgaaagaatatcatccttccagtaagcagctagacttttattctcattgagctaggaatgcatatgaataaacatattgttaaccattgaaacatgctcatttcagttcatttggccatgactctggctcatttttcctggcctctttcaatgtattagtaaaatcccgacttattcatttgactgaggatagcatattcctgagagttatgtgttgatggaaaataaaaaacagatgtgtatctacattactaatcctgctattaaaaagcaactgaacactgaatgatgccttaagatgtgacaaaagccaacctgatctcacctgggctcgggctgggttctgagatggcctcactcacaggtctggcattcaggtggagtgatggaagaaattggaaccctcatttcaccaacatctagaagttagtttagtgttcctcacatggcatttggatttcagaaacatcaggagtataacaagcaaaaaataaaacaaaaccaagaattttcaaacttctgtgtacagaatggttgctaatgggagaaattagaaatactggagccatttttgtctttttttgcagtcttctagaatactagtttaatttcactttttttttctaattgccttgtaaaatacaagtgagttattaaattaacttggctctttttcctgttaatgtattaaagataccttataaatcaaatgaataagaatgtaatgaggcactattatacctagcactaggtgatggcaagaaggaaaaagggcctctactgttttcattagtttatcatacatcatggtttccttgataaatcgtgagattgctgtcaatattttttgtttcttgttttctttttcttaaagagcacacatttattatcttacagttccaagtgttagaagtctaaaataggtctcactgagctaaaatcagtgtattggcgggtttgcattcctttctaaggactccaggggagaattctttttcttgcttttccagcttctagaagccccttcaattcctccaggccacttcctccatcttcaaagccagcaatggccagccaagtttttctccatcacaccaatctgactcttactcctctgtctcccccttccacgtttatgtttttttatttcaataggttttcgaggaacaggtggtgtttggttatatgaatatgttctttaatggtgatttctgagattttggtgcacctgtcaccctagcactgtctactgtacccaatgtctagccttttatcccttaccctcctcccacccttcccccaattccaaattcccaaagtctattgtatcattcttatgcctttgcatcctcatagcttagctcccacttatgagtgagaacatacaatgattggttttccattcctgagttacttcacttcaaataacggtctccaatacaagttggagagattttttatcaaagaaaaactactgctgcaaactgttctctttagacctgggtgaccattgctcatagaaaggatgaagtaacaatgttgacaagcctttgtcaaaccagagctactgctagtattggggttaaggccaggatcaacaaaacgtatattccccacaggtggctgccccttggtatttggctgttctcacactgctccaaagaaatacttgagaccgggtaatttataaggagaagaggtttaattggcttatagtcccataggctgtagaggaagcatgctgctggcatctattaggcttcttgggagccctcagaaatcttacaatcacggcagaagccaaagggggaacaatcatgtcacatggtgagaatgggggggacagagagtgtggaggcgcaggtgccgcaaacttttaaatgtccagagcccacaacccacgaggacagcgccgaggggataatgctaaaccatttataagaaacacactcccatgatcaaatcacctcccaccaggtccccccttcagtaccggggattacaattcaacatgagacttgggcagggacaaacatacaaactatatcacccttcatgcttatgctttctaactgtttaacacttaaagagcatgggaagaaacttattttctattagaaaatttttatctttattaaaatatgagagatttattacacacactcagtgtaacatggcctttgaacttaagtttgctgtcattgttcttttttcgttgttcataaactgagattgttcattactaataccctagatgattctagtcacctaaattctttatttaaaaataatggaggaggtataaaaatatgttcaggaaatatattcatgctactcagtgaagactgtagaatattacgatttagcacatggaatatagaattgacttcctagttgcaatccaagttcttccacttgctatttgtgtcaccacaagcaaattattttaacattcttaagcatcacatttctaatttgaataatagagacgataatttcaacctccaaatattgatgtaagagttttaaaatataatgtgcgaagagttcttaacataaactcaccgttcaataaggtggagctgttatcattaatgtagtttatgagactgttatttccattataaacttataggtctttagatctatgaatttaatcaaatgatcttacttttggacaaatttaaaacaacactgaggggagatgaaataacattgctggaagaatgtacacttttatttttagaactgcatttttaagaaaatatgcagaaaacataattctgaataagtagatgaatatgtctctgatgttcttttgaagtatgaactcctcttctaccttcaattttaactcttacatttcaagtaaaaaacaggtcatccaaagcatcctttatgtcagacacaacactggcagcagcaacccctattactaagctctgttagatactttatcatacaaatatttgaatctcatgttgccattgaacatctcatatttttatcgatatgatgatattttaaaaccccataatagtgcctacaagatagattcacttttaatagaatttatctatgcagcagctaatatagtgaaaagtaccgtgatctatggtatttgggggtggaaaggttgaacctttgtctagcattgattatgaaataatttgcctattaaaactatagagatttattaatctgtgttagcatctgctctttcatttttaaaatattttatttacataaattatcaaaagtctgttatggatatatttgcctctgtgtataaactctcctccctgaagagtcttgtaatagttttctcttctttcttgtgcaatgcctattctgcagtcatgtagtcgaggccttgctctggctgtactcacaggggctacctggaaaagtcattcagttgcatggaatactgagttgtgtcaataaacgctttctcaatagctttcttttctcctcctgccacctgccttcccactccaccccctagtctgacattctcaggttgcattaattctgtctcatgttctctccattagtgtgaattatttgttatattttgctttaattgccatccactgtagtcttttttaactctctccatctaattttgtccattccaccttcattatttctactcttttcccaaatctctcccaaggcacagattccccaggctctcccttattttgctagaacatttagtatgtttcctttaatttttaaatcccagtaatgactgatgcttccaaacactttggatattgggattttaggttaaagatgattcatggtatgaattacaaagaaatgatttagttcaaagtgactggattagtgatttagaggagactaaaatttaagattacttaaggtaggctcgggagaaaaaaatacaaaactaatcataaaattttgcctaaggattatgtcctctttgaatatgttccttattcccaaaacatcctttggctgtaaatatagataattcagttttatagttttacaactattcagttaatttacaactccttaaaagtgaggttagtgtcttacactcactgagaaacatccccaaagtcttgggatttcatcttctgtctttcaagatttatttcattatgaagcaggttgctcaccttccaaaagtggaaatccttcatctgtaaaacagtgttaatgatgtatacttcagagtcttagtatctagggatcacagcagcaaaatcaggaactaccataattgctactagcatttggagaaaaatattccacagtgtattagaaagcagaggtgttggtgttagtgaaaggtgggtttgagtatcagctcatgggacatactaatggcctgatcttacatttgtcacttataccatatgactctgttctctcatctagaaaatgagtatcatgggttaggcgaggtggctcacgcctgttattcccgcactttgggaggctgaggcgggtggatcacgaggtcaggagatcgagaccatcctggctaacacagtgaaaccccgaccgtctctactaaaaatacaaaaaattagctgggcgtggtggtgggcgcctgtagtcccagctactggggaggctgaggcaggagaatggtgtgaacctgggaggtggagcttgcagtgagccgaggtcgtgctgctgcactccagcctgggcgacagagcgagcctccgtctcaaaaaaaaaaaaaaaaaagaaaagaaaaagaaaatgagtatcataatagcgctgtattagaagacaccaatgcctgtgctcagcagagcagtggcatccacattctctttttgtgcatagttttccagcacagagtagaacgcaccaaatgtgttgattaactgattcctataactttgaatatatcattaaggaacacaaactaagtaggtcagaagactatagtagataaaagaagaagaaggtacaattaatagtgatattgacacaaaatgacagttctcaaaaaaaagttcacgaatctgtataatgatcaagattaaagaaaattttactttgaaaactaagtttggtaattatatttagcggcaaaaaaaatgatgatcaaaacacttccagttaacacaaagaatttaaagttgtgattagcttgtagatagaacttgaatttcattttgagaatgattgaagtttgggttaaagatggaactcaaagaacagcaatctgcccacttaaaaagttactgtttccttttttcatattaaagtgttttattctgtaatgacgtactgagagacagaaactcacccagcttgggttaaaaatcatacaggatccccatgtttctcttttcggttcctctttacaatgggcattccactatgagatagcacagataacttggctgagaactcttcatttacacacaagatgcacagcctggaggtatctcatagcccttgtcatggactgaattgtgcccctcccaaattcgtgtgttgaaatcttaaccctcaatacttcagaatgtggctgtatttgaagatctggtctttaaagagataaaatgaaggcattagagtgggctctaatccaatatgactggtgtctttacgagaaggcattaggatgcagacacaaaggggagatcatgtgaaaacactagagaaggatggtcatctacaagccaaggagagaggctgcagaagagctacatccctgacaacaacctgctctaggacttctagcctccagaactgtgagcaaataaatttctgttgttcaagacttgcagtcatggtatttgttatgacagccttagcaaaataagacatccgtgttcacactgtctccagcactggatgtaggaaaatctcttttattatcttattccaaaatttgctcaatatctgaaaggtaatcttcagattcagatctgtgtgactctaaacaaattttgaaattttatacatattgaaattttatacattatatatgtataaaatatatacatatatatattgctaatggtaaaactattacatgaacctagcaaaattatcacttgggcttaccattgtcatttttactactaataatgtaacttttagggttgaatgtaccaacaacacttttaaacattctatataatattgcaagcagttaattttgttgggtagtttcataaggctattttttatcctcctataaaatatttgagtttttaagggaagccccccaaaattgctgtatcagaaaaaaaatggttttgtaattgtgcctctaactctaaaatggaatattaaaaatgatggataaaattttcacaatagtactttaagacatctagaaatttgacagatgattgtcacgattcaatccctttttcttcatgttttgcagtataaagcaatattttaattgagaagcatttgacaaaacagaaatacatgctgtatacctctttatgcatctgttgagatgttcttaaagtcagcattgatttgcaaaggccaagtgccccacagcccactggagaagactagatacaattccacaaatgcttactactgtgtcgaaatttgtagcagttgctctgattttaggtatggatatgcagatgaataagtcatgtctcctttcgtcacagattttacagtctggtggagagacaaacatgtttaatgttatttagcacagtatgtgctatgagagacacctgtatatatcccagggtttatcaccaagtgaaaataagtgatctcaggttgactgataccttagcacagagtaaaatgaatttgaggcaggagcacgttttctaaatgtttttgtgtgctacaaggcaaagagaaaacatactgctcaagaaataggagatagttggggaaaaggcaatttatacatgaaaggtatgagaagcaattctgaaaggaagatagagataagaaataaggcataaaactaccacccactaatcgcctttccccaaaaaaatgaataagcaaaggtcaagatcaggggctttgaaaagagaaatgcttgaactagaacatacacaataggtaaaacatatttgcattggatccacaaatgcagaacaacccccgatatccccaagccaacttttcaaatttttataaaaatagactagaattaggccaatttaaatcatcacttatttgttgttgcagccaacatttggatagttattagcatcattcattcctgaagcatgtattgaatgcctactatgttccacacaattcaataacaaataaaatcaagcttagagccaagtgaggctctaataacttcgaaatggcgatatcttcatctatcctatttattgagaattgtctatgtttagagcacggtagcagggtacaatatagccaaatgctgtcgctctacataggaaaacacaccgagttttatctgctactggttttcagctgccagcagttctggaaaatttgagaattgtctatgtttagagcacggtagcagggtacaatatagccaaatgctgttgctccacataggaaaacacaccgagttttatctgctactggttttcagctgccagcagttctggaaaattgcatcctaatgacagatgctactatttaaaatgaaaactgattttttttttttggtaaaagagactgagagaaaaacaagttttagacaaattccaaagcatgaaagaatgctcatcccaaccatttctgtgggaagaatatctagaatgtggttggcagccaaatagccatataactgtgtaattgcaagctgagtagagaaagagactagcgtcaagtgggagatattccagggacaagtagaaattcaagggaaaaacgcaccgtggggtcacagaataagtcttttcacaaatcctgtgacaaatgctgtttgccacatgtacttaatatctaattggaaagataattctggctgtctttagctctcagggctcttaggagtttgatgtgacatacaggtgttaaagtacgtaaaaaatgttaaacaccagataaatggaaaggtttgtgattaaaaattaagtttcaccgcattgagaaatgccacaagtaggcagacttgcagaagtattgtcttcaaagatgtggaatgagctatgtggaatgaaccaagaataaaacattcctcataattgtgcccatgcttaaagccattgccaccagcagtaactttatcaaaagagggcataatcagtcagaagcaaacaatttcaaatcactgcaaatatcatgtgacccatctgaagagccattttgccacacttttaaatgtgtttttctcctgatggatgattaaataggcagttaatgtcctttttccttgagtgattgaaggacactaagtcaaaattacaatttagacaagacaaggaattctgcactgatgttctaatagcacacgatatttgaaatgatgatttatactccagtccttcttgacaggatgtgcctcatgctgaggatgtctgtctgtctgtctgtctgtctgcctgattcattggcacatgtctttttgtctggacttagtactggttctccatgaagtaggaccctttacaactagaaaacttacccttacccccaccatgtctctgggctgaaaactaatagtcccaccaaaactgtggccagagttgttggaagactcttcctataattaatgtcctataaacttaattctcttcaacaaacattcattagatactaactctctttgttaagtactatagactacacaccacacaaggataaacctccagaaatttatcagctgctaagagagataaaccatgtacatcagtgtggtaagatattttgtattaaccatctgcctctgctacccctcctcctgggtcctcacacccactctgtgtacccagttagatttcatatgccaatttccttggagaagcactccatggagaactgagaaacaacaaaatgaaatgctttgctcttaagttctaatgatgaaatccatggagatcttgatccaaataaataaataaataatctatgatccagcttgttatctcccaactgaaactacacaaaggatctacagagcaggtgaaagaatgaggcagtggtccacattaactaaaatgagcttgataaggacagaccgctgagccccgcttggcaggcgcgtcagtaaccagcatcagggagtcagtggaactgttcttctcctacggaacctcaggtcttcgtgcagataagccctgtacattgcctgtgaaaagaagttctatcagctttccttctctttgtcatttgatgaggctttttaatcactttaaactcccagctcccatcaccgtatcttttttatgtggacaagcctctttccaaaaacccaggacacaggatggagtcctggaccccccaaaaaatggcagtgatgggaagggaaaagtcccacaaccaagaaagatgggatttagcagaagcaactgaaaatcttccactagttgaggcagtgctaaaaccaatgctcatttgacacaaatgttttcttaggcgtattccatggaccaccaatatactgtaaggtgaaagtgtctttattattaaaaattcataattccatagttaagcaagctctcaaatgttttatattctaaatccttccataaatgtctcaagactccaagaaacatatagtaggggaaaattacaatttcccaaatttaaacgatcacaaaattctttgtcaagaaacatcaatcttacagtacactaatgttccatggacaacagtcttgaataaatattatttaccatgaaatatattgcgtatctattatgagttaaatactaatctaaaagaataaactagaaagcagtgttaaccttaccagagacgcagattaaatgttgcagagattcaaaggaaagaaacctcattcctagccaagacgtataggcggtgatttcaggaacatggcatttaggtatggtcttgaaaatcaggcagcttttgaatattggggggtggatgggggaaagttatgctgtgatgagaaaatagcagaacaggtataccaaggggaagagaaccagcatgaagaagagaaagtagcttttcttggctgtagaataggaaacccaaacagattaacagatatgacaaggcagaagaggctgattggggccaaatatggggagcagtgatttcaaaacaaagtttgatctttacttcatagaaataaccatgacctgctccaggttaataagcaaaataatcacacttctaaggcatgactttcacatcatccaattaacatattcatgatgcacatattatcatattgcattcatgagtaacgtagagttaaccctccagttaaaactgtgagacagaaaaaacatattttttgtcactaccctttttttctgctctgtgcaacttcgctagaattaactgtggtcctatcttctgagtacatactaattagacttcctgccacctaagaatctttgctatcctcatttttcttcctcatggatatttttcatttttcctcacctctctctgctattatctatgcacctctccacttttcaattattctacatatttaacaagttcccaagagagaagagtgtccaactggtgcattttatttgacaatagctggtatttatgtaatgagtgctgctatgtggcaagtttttcttgcatacatttatttttaagaaacacacattaataattcccctgtgcaagagatgaaggtaagaggtaatagtaatttacacaatacaaaccagaagttccaatttatgcctgtcagactacaaggtgcattcgtaactctggtaacaatttatttctgggccttcagagacaaggttgcttaccttcctaagtaactctaattaaaacaacaacaacaaagttttaaggaggttgaggatgaaaatttggccttagaaaaaacaaaggattatctaaggtttgcctattccgttcattcaataggccactctgcttaaaaatttaagaattcgctaaacctcagtccactctgttaacaatattcattggaatattaaatgtttatttatttatttatttttgtctaaaggatatttgggaagtatactgtatcaaagcagcagaaaaggagctgtaatagttacttttcagtgtaatactaagcagttaatttttttaaagaatgatttcgcggatttttaaataacctgattttataaggtaagcaaaacctacttaataaatgaaccaagtctaaaatctacctataacttaccagcagaaaacttaaaaataactacattattatatttcaaagtattcttaaaaacttgaattagcctctgtaaaactgtaaaaatacaaaataattgattaaggaataatatataaaagatgggaaaggacatagcttatgagaagaaaaaattaaatagagaaaaggaaatagtgtgatactaattcagttgagtaaaaattcagttattcattgtttttcttaccagaaatatgacagttaggcaaactacttaaactctgtgttttagctttctcatctacaaaaagagatatgaatagttcctacttcctatatagttgttgagaagttacaagtagttcataattgtcaagggtagaggaagtgttcaggatgtagtatgagccatttaagtattgactactattgttactaaagggactgaaaatgacaactatgagtattttgcattttgcttgaaaaataaaacgacgtgtggatacaaaagtattaaatatttgcaaaattcacaatctatgaagaattacacaaatgtggatgacaatggtcgaagaattgaagcactatggtgatcattagagactcaccaaaccccttccttctccttgggcacacagtaggatttcatttctcagccttatattgcaactaggtgagtccacgtgacttgagtgttgtccattggaacatgcacaagaggtatgtgggtcacttccaaatgtaaaatgtcaaaatctcccacagtatccttggtgtgttctcactcctcatatcctgggcagatgccaaaggagatttcactggcattgggagatctcagagacagagagagcctgtgtgctctaatgatggtgcagtgaacagcctccacttcccaacttgccatctcacattttgatcacgtcatgaacattttttgttttaagccactttggtttcgaacttatttttcacaggaattagcctactataactgacagagtaacgaaaaagtattcaaacaggaattgggacacttgtgtccaaattgcctttctcacgtttactaactatgtaaccccagggatttactcaatctctgaattttcttttctttgctgtaaaactcctattataaaagttgtaggtcttcaatccatcttgaattaatttttgtataaggtgtaaggaagggatccagtttcagctttctacatatggctagtcagttttcccagcaccatttattaaatagggaatcctttccccattgcttttttttctcaggtttgtcaaagatcagatagttgtagatatgcagcattatttctgagggctctgttctgttccattgatctatatctctgttttggtaacagtaccatgctgttttggttactgtagccttgtagtatagtttgaagtcaggtagcgtgatgcctccggctttgttcttttggcttaggattgacttggcgatgcgggctcttttttggttccatatgaactttaaagtagttttttccaattctgtgaagaaagtcattggtagctttatggggatggcattgaatctataaattacattgggaagtatggccattttcatgatattgattcttctgacccacgagcatggaatgttcttccatttttttcgtatcctcttttatttccttgagcagtgttttgtagttctccttgaagaggtccttcacgtcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagtttaaggagattttgggctgagatgatggggttttctagatatacaatcatgtcatctgcaaacagggacaatttgacttccttttttcctaattgaataccctttatttccttctccttactaactgccctggccagaacttccaacactatgttgaataggagtggtgagagagggcatccctgtcttgtgccagttttcaaagagaatgcttccagtttttgcccattcagtatgatattggctgtgggtttgtcatagatagctcttattattttgagatacgtcccatcaatacctaatttactgagagtttttagcatgaagcgttgttgaattttgtcaaaagccttttctgcatctattgagataatcatgtggtttttgtctttggctctgtttatatgctggattacatttattgatttgcatatattgaaccagccttgcatcccagggatgaagcccacttgatcatggtggataagctttttgatgtgctgctgaattcggtttgccagtattttattgaggatttttgcatcaatgttcatcaaggatattggtctaaaattcaattttttggttgtgtctctgcccagctttggtatcaggatgatgctggcctcataaaatgagttagggaggattccctctttttctatttattggaatagtttcagaaagaatggtaccagttcctccttgtacctctggtagaattcggctgtgaatccatctggtcctggacgttagactaaaaccataaaaaccctagaagaaaacctaggcattaccattcaggacataggcatgggcaaggacttcatgtctaaagcaccaaaagcaatggcaacaaaagccaaaattgacaaatgtgatctaattaaactaaagagcttctccacagcaaaagaaactaccatcagagtgaacaggcaacctacaaaatgggagaaaattttcacaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgacaaaatgctcaccatcactggccattagagaaatgcaaatcaaaaccacaatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcaattcctcagggatctagaactagaaataccatttgacccagccattccgttactgggtgtatacccaaaggactctaaatcatgctgctataaagacacatgcacacgtatgtttattgaggcactattcacaatagcaaagagttggaaccaacccaaatgtccaacaatgatagactggattaagaaaatgtggcacatattcaccatggaatactatgcagccataagaaatgatgagttcatgtcctttgtagggacatggatgaaattggaaatcatcattctcagcaaactatcgcaaggacaaaaaaccaaacactgcatattctcactcgtagatgggaattgaacaatgagaacacatggacacaggaaggggaatatcacactctggggactgttgtggggtgggggatggggggagggatagctttaggagatatacctaatgctaaatgatgagttaatgggtgcagcacaccaacatggcacatgtatacatatgtaactaacctgcacattgtgcacatgtaccctaaaacttaaagtataataataacaaaataaaaaaaaaaataaaggtggtaggaaataaatagtatagtttcagggcttggaatggagtgtaaatattgtaatggacagttaaatctaaatgtagcagtaatttagtcaatacttacatagcactgaaatgtctatattgggtaggacaattagtaaaatcatattttaacaataataacaactatttagttgcctgaatatttcacttttcaatagctgatttcacaagaatgcagctctcaaagatatcgtgttgcttttaaccattttctccagatacatggtatcaatatattcaagaaaagaacagggttttatttttttcctgatgtctttgcaccaattttcccaatttcttttctaatagagtagcttgtatttaatatgcacaacaactgcaggtcattaattctctgagtctttcctaaatcaatcctctggatgtggactagaatcttaatacagttttagtagttgggaatctcatctaatttattacatggagagaggtatgacacaggaaaaatgcatattaactatgtagatgaatatgttttttttttctttccaagtatctgttttcttttcaaaatgatcatgaatagatagctacctaaggaaggttgtcacattagcttaatcaatatagaaattctatatatgaatatatatataagaatatagtattatgcatgcatgtattttacagctagttgtctattttctagaggcagctagacagtggtgaagagcaagtttcagctttgaggttttttttaactttttattgggaaataaaatagacaaccacgaaaaaaatgcattaaacattgatgtaaaaattaacagttggatactaaataaactgttgtacaactatcacatataactagaaatttaacaacagtaccagcacctcagaagccctccatgtgccccttctcaattaaaattcctccctctacccgatgaaaccactcttttaacttttgtcgtaatgaatttcttgctttcattatacttttaccacctaactatgcatccttaaacactatagtttaattttcatgggtttttgaagcttatgtaatgaaatcatcagttttattcttttctaattttttctttaacttaaaaatacttcataagatttattcgtgttagggccaggcgcggtggctcacgcctgtaatcccagcactttgggaggccgaggtgggcagatcacgaggtcaggagatcgagaccatcctggctaacatggtgaaaccccgtctctactaaaaatacaaaaaaaaattagccgggcttggtggcgggtgcctgtggtcccagctactcgggaggctgaggcaggagaatggcgtgaacccgggaggtggagctggcagtgagccaagatcgcaccactgcactccagcctgggtgacagagcgagactccgtctcaaaaaaacaaacaaacaaaaaagatttattcgtgttaatttatgtagctgtagtttgtgcattttcaatgctgtataacaattgtttgaagatgccacaatttttatatctgttttactgttgatggacatttgggttatttccaatttgggactattacaattgtgatgccattaacatttttgtgatagtcaataacaacgtacacttaaatttttgtcaagagggtaggacttcacattgggttcttaccaaaacaaggtaaaatagtaaaacagaataataattcttgtacgtgtctcctggtggtcttagtggtcatgtgcacatctgctattggatgttgccttagaggtagaattgttggcttagaagtatacaatttatattcctaccaacagattatgagtaaaccagtggctccccttccttaccaatgcatgagcattctggtgagtatattatactattgtagctttaactgtcatttgattgattgctaaggaaattgaacacatatttatgtttctcagaaatttggattttctcatttgtgaagcagctttgaagtctttgctcttttttgactgggttgtttgtcttctacaattgctatgtacattctgcatatagtgttttgttcatttacgtgttgcaaatattttttctttcattctttagcttatcccttcatcctcttcatgtttcattttcatttgacaaacagaagtccctaattttaatataattttccaacttcttctagtatggttattaccttttgagatgtgtttaagacatatttttcaaatgtgaaggttaaaagttccccaaaatactatctatgtaatcttctttaaactttgcagctaaatagctttaaaatttagctgtatgaggtattttcaaaaagttcatggaaaatgcatattatgaaaaaaactatgcatgtatttcaaaagtttttgcaccaaaataaactcagactaacttattaaaacatgcctaaacaggatctagtttgaggcactaaaaaggataaggtataagttataaaagagcatctatcagaaaaacatgaattgtgctaacattgaagcaagaacaaacatcaaatttataattaatggtgaaagaatggtgaaatcagtgatggtttacaaaaagtctatggaaaaaatgccccaaataagtcagcagttcacaaatggataactcgttttgtttttttgtttgtttgtttgttttttgtttttgatacggagcctggctctatcacccaggctggaatgcagtggcatgaactctgctcactgcaagctccacctcctgggttcatgccattctcctgtctcagcctcccgagcagatgggactacaggcacctgccaccacacctggctaatttttgtatttttaatagagatggggtttcaccttgttagccaggatggtctcgatctcctgacctcgtgatctgcccgccttggcctcccaaagtgctgggattacgggagtgagccaccgcgcccggccacaaatggataactcattttaagaagggatgagatgctgttgaagatgaagctcatagttccaggtcattcacatcaatttgtgaggataaactttattttgttcatgtcctaattgaagaggactgaagattaacagcagaaacaatagctgacatcacagacatctcaattggcttagcttacacattcctgactaaagaattaaaattgaatgtgcaaaacgtttgtgcccagatcagccacagaccagggcagagctttcagtgaaaattttaaagaagtgggatcaagaaccttaagctctttcttcaaataataataatggtagataaacatggctttaccagtactgtcctgaagacaaagcacaatcaaagtaacagctaccaataagtggtgtggtccagtcaaagcacaagcagaccagtcaagagcaaagattatggcaacagctttttgggatgctcaaggcattttgcttgttgactttctgaagacccagagaatgacaacatctgcttatcatgagagttctttgagaaagtcagtcaaaacttaatcagaaaagtgcccaggaaagtttcactggcaagtccttctgcaccatgaaatgtttctgttcattcctctcatcaaacaagggccattttctgagactttttgatggaaaaatcatttatcatccaccttatggtctatatttggctcttcctgattcctttttgtttcctatgctattgaagttgttgatttatttaagtaatgtgatcaatatcaaatttcatttttttcaaatggatgtctaattcttcccacatcatttattgaagaactgtctctttgctactgtgcttcaatgctacctgtgtcataaatcaagcatttaaaaatgcaacagtctatttctggactctgtgatcgttcagttgtctgttttccaatcctggtactaatatcacattttcttgattgctattgctttaaaataagccttgatgtcaagttaagaaactcctctcatgttcttttttcaaaggaatcgtggctattattgacctgttatttttatgtgcattttagaaccagctcgttaagttctactgcatccccaaataaaaagcaagctggtatttttaaaatagactttattttttagtgcaactttgtgtttacagcaaaattaagaaagtacagagacttccctgatactacgagctcgcacacatatataaccctccccattataaacactccccaccagagtggcacatttgttacaactggtaaacttacattgacataccattactaccccaaatatattgtttaattaagtttcactcttggtggttgtacattctatggatttggacaaatgtgtaatgacatgcatctatcattatagttttaaacagaatattttcactggcctaaaaatcatctgtgttccacgagttatccctccctcctccctcattcccagaaaccactaatctttttattatctctatagttttgcctttgccagaatgttatatatttggagtcatacaatatgtagactttttattggcttctttcatgtagtaatatacatttacattttcttcatgcctttttatggcttaggagctcatttctttttagtcatgaataatattctattgtctgatgtaccacagttgatttatccatttacctactgaagggcatcttggttgcttccaagttttggtaattatgaataaagctgctataaacatttctgtgcaggtttttgtgtgaacaaacctgtgagttaataccaaggcattcaatgaataatatggtaaatgtatgtataagccttggaaaaaattaccaaactgttttccaaagttgtactattttgcattcccaccagtaatgaataagagagctcgtgttgctctaaatccttgtcagcatttgatgttgtcagtgttttgaattttggtcattctaatagatgtgtagtggtatatcattgtttcaatttgagttttcctgatgagatatgatggggagaagagattctttgtcctcaatatctcttctttgatacagtgtcttttggtattttcaattagactgcattatatctcaagatgaatttggggagaattgtgacctttgtctccacaaaattatatgttgaagccctaaccatcattgtgactgtatttggagatggtgtctttgggaggttattaaaacaaactgtgatcataaaggtggtgccataaccagataggatttgtagccttataaggggagaaagagtgtatctctccatgcacatacatcaaggaaaagctgtgttagaacacaagaaagtggctgtctgtaggccaaaagaagaagtctcagaatgaaatctgccttacaggcatcttgattttgaattttccacctttaagagcaggaagaataaatttgtgttgtttaagctacccagtatataatattttgttatcaccatctgagatgacaaatagattttggtaccaggagtgaaatactgctacaacaaatacctaaaaaggtggaagtgactcaggagctgggtaatgggtagagactgaagaagttttgagatgtatgccaaaaaaatatggacattaagagtggtttcagttagacattagaaagaaaagaggagagctggagagaaaacttccatctttttagagactatatagccatgaaaagaatttgataaaaatatgaatgttaaaggccactcttgtgagatgtcaaatgaaaatgaggaacatagtattggaaatgacaaaaagtgagacttgttataaaatcgcaaagaacttggctgaagtgtgtttgtgttctagtgtttggtagaaggtagaactggcaaggattgaaatcaaatacttagcttaggaaatttctaggcaaagtgtcaaaagagcagctttgtttttcctgactgcttatagtaaaaagcaagaagagagagatgaattgaggaagacattattaaacaaaaaggaactggaacttgaagatttggaaattctcagccaattcatattgcaaatgttgatgataaagtatgtactgaggacaacaccaatggtgtgactggactatcacttgataaaatgtatgtaagattatactaacagaaatacagcaagtatgaactgaagggaacaaagataagatgaaatgaatgaaggccatcagactcattaaatttcacaggatgagtagatagaacaatttggctgcaaatgtattctatcctttaaaaagagagagaaatggccccaagataatttagagattttcagggccactaccttggttgcaacaagctagatagttgggggcagaactcgctagcagagccttggcagcaggttcttagggatgaggttttagaggcaggagcttagggatgagaccctaagaacaggatcaactggcagattttatagagccatcaaagccaagggtttctatttctagatattttttatttcagtcttttcacatatgatatttacatggtaaaattttatttactgtttattgctggaattagatataaattgtgtttgctgacttttgccagcaaccatgtcaaaactcttattaattctaataatttctttatattttatcattgcattttaatacacactttagtattatcttgccaatttctgctaaaaactacctgagattttgtaggattgtgttgagtagacaaatttgggtggggggagtgggtattacatttttaacaataataaatatcttgatctgttagtataagttgcttttctatttacttagatctttaatttctttaaataatgtttccatttatggtgagacatcttcacttctttggattaatttattcctaagtattttattcttttgatgctgtcttaaattgaattatttacatttttagtttattttattgtatttttaacttttattttaaattcggattacagatgcaggtttgttatctgggtaaacttgtgtcatgggggtttgttatacagattatttcatcacccaggtttttagcctagtaccctttagtcaatttttctgatcctctcccttctcccaccctgcaccctccaaaaacaaatatcatttaacctagcaatcccattactgggtaggtacccaaaggaatataaatcattctatttttttattttttgtagaaacagggtctcattatattgcccagactggtcttgaactcctggcctcaagtgacctgctggcctcaatctcccaaagtgttgggattacaggcttgagccaccaggctcagcctgtatatagattatataattgatttttgtgtattgatagttacatcctgcaacattgttgagcttttttattagttataataactttcattttatttcttaggatattctgtatatataaaatcatgttaactacacataggataatttacttctttcttttgtatctgaatgtcttttattttattttcttgcctaattgtcctggttagattgtttagtacaatgttgaatagaagtcgtgaacctgggccgggcacgggggctcacacctgtaatcccagcactttgggaggccaaagtgagtgattgcttgaggccaggagttagagaccagcctggccaaaatagtgaaaacccatctccactaaaaatatatacaaaaaaattattccagtgtggtggtgcgtgcctgtagtcccagctactagggaggctgaggcatgagaatcgctcaaacctgggaggtggaggttgcagttagcggagatcgcaccacttcactccagcctgggcgacagagtgagttctatctcaaaaaaaaaaaaaaagaaaaattagtgaacctggacatacattcttgtattgttcctcatcttatcaggataatgtatagtccttcaccatttttaacgtgatgttagtttacatttttcacagacaccttttattagtttgagtaagttcactagttttccgtgttcattaactgtcataaaaagaagtttgtatttttctaatggtttttctgtagctattgagatgaccatgaggttattgttctttaacctattaatataatacattatattaattgattttcagctgttgaaccaaccttgcatcctcaggataaattcccacttggtcatattatataatcctatttatgtgttgctggctttgttgtcctagtattttgttaggttctctatttgtatgaaaaagagatatttatctgtagctttcttatggtgcttttgtgttgtttggtgtcaaggcctcatagaaggaggttggatatatttcctcattttctatgttttgaaaatttgcgagagagaggtgttatgcttcaaattttctctagaatttactaatgaagccatttgggcatttatttgtgggaagttttaagatttttaatgtattccctatgatttgtttcaatccattcagatattttaatttttcttgaatcagtcttggtagtttgtttctagaaattattccctttcatataagttatcctaattttgacttacagttttttatagtattcactttcatatttaaaaaaaaatatttctgtaaggtcagtagtaattttagcaatgtaagtcttctttattttttttcttggtcggtgtagatagtgtttttaatttattcatcttttcagagaaccaaattagattttcttgactttctctattgtttttcttttccattaatttctgttctaacttttattattcccttctttatacttgctttgtattaaattgtttctctttttcctgtctcttagcaagaaaaataacgctatttagttgggatctttctcttttttaaatatagaatttacagctatatatttatcttaaagcgctgcttttgctgcatctcatagaatttagtatgttgtgtctttatttgcatttatcttaaactattttctaacttcctatctgtgagcattggttacttagaagtattcattattacttttaaatattcctgcatattcttaaatgtccaaaatttccttcttattgatttccaatttagttttattatggctggaaaacatgtatgatctcaattttataagaattttttcaggcttgttttatgacagcacatatgttctattctgcagaatgttccatgtgcacttgagaggaaagtgcattttgctttaatggcttcggtgttcagtacgtatctgctatgtctagttggcttatagtgttgttcaaacatgtattttcaaattcttatatttccttgctgatcttctgtctagttgttctacttattattggaaattgagtattaaagtttccaactactattgttgaagtgtctctctcttttattttgtcagtttttttaaatataattttggcttctgatattagtgcatatatgtttgtaattgttacaccttcctgatgtattgagtcttttatcactataaactattgctttgtatctctggtaatatttattttttgttttaaagatgatttcatctgaagttaatgtaggcactctagctctctcagggttgctatttgtattgtatgacttttgaaatatttgtactcaagctagttgtatctttgaatctaaagcatatctcccttccaaagtgtataattgttttgatggttcttatctagtctaatgatctttcactcttgattggattattcaatccattcacatttaatgttattattgatactgttggatttgcatctgctagttttcttttggtattgtatgtctcacgtctctttttgtttctctgttcccccatactattttttcatttaataaacatttcctggtattaattttaactatatcttttagttacttgcttagtggatgcactagggtttataatatataccttaccttatgagaattagcatcagacttatactatcttaattccagtgagctggatgagttttaatcttataaagctctattccttctttcttctttttgtgctactattgaatattttatcatcaattatgatgttttctcttaagcttttttaggaggcaagatggacaaacatttcaataaatcactatttcttaaaaatctggaatgaatattaaattttaccagatgctttttctacatttattgaaataattatataatttattctttattcagttaatgtgatgaattatcttgcttgattattttttctgtatcaactttgcatttctggaataagtacatattgatcctgataatattattattttaaaatattgttggcattagtcaattaatattttactgagaaatttttatctatatttgtgagtttggctagatgattcttgtcatattttagtactgagtttactacattgtcaagttgaagttaattaattttttataatttcttaaagttttttttcttaagtttgaaagaaatcactactaggaatatatttattccatctaagttttcaaatatgaatttcaaaattttggaatttgaaatttcttctcaataaactatattatcgttaggcagacatgagtatgaatctggtttcacccacctatcagctatgagaacttagaaaattcagttgatttctctgatcttcagttttctaatgattaacacatggataattaatagtacctattgcatttctgatagcaaattttctatatggactactcctgatggtacaaattatttaaaattcaagataaaatgtataaataattctttagctggaagagaaagcagaaaaatcctcaaacagtataaaacatcagtacagagctaactttggccttgaggcatctgtgaatctccagtagcttacaaattaggcttacaaaacctaaagccaagtaggataagactccacaaaaatccagattccctaaaatgcattactcttgatagaatcttgggaaaaatcttgccattcagtaggaatgtgtggagatgtatagcgttcttagtctagatcctgagtaaagtagaaaaaaactagtgctctccaagaagtcttagctacaagtcagaagtcaatgagttgggactagaattcacaagatttttgtgccttagaaaaaagaaaacaactgaagtcaatttctgtttaaagttgttctgagttggcagtgtacccaggtatctggaaagaacaaacacaaatcttctttataggaagcactttcagtctgacctgaatgtgtttacagagaaagtttaaaaggatataaatatatgcacacagcaggaaacatctaaaaaaataagccgctataagcaaaagtcagcagacgtaatgaactacagactcagtctgtaggttctgcatatactaggtcctagaatcatccaatactgaattacatatctatgtatctatatctatatataaacatgtgtgtgtatatatatatatttatatatagctgtagatagaattaagactttatgaagaatagagaactactgtagtataattttggtaggctttaggcacttaggccttcctgcataaataaataaataagataaataaatgtatacacacacatataatttatattttatgactgtgctggtataagcacaaatatattaatattacatatcaaaacattttcttcaatccaaaggttattttatttcttctagttttataataattaaaacattttaaggaaatgtgccaggagccctaggcattgtacctaatggataatttggcccttggaggaagcaataagatggtattgacagccagatttagaaagtaaccaaatagaatttttagactttaaaagatttaattataaaaattataattttaatagtggcctaataacaaattcgacacagctgaagaatgaattgttataataaactgagagattttaaaacacgttttctcatttctaatctaataatatttttactacattctgatttctatttactaagcagtttgtggtcattggccttattttgtgcctagaactgtgttatgtgggattagggtataaaacagaaaagctattcacatatgtaattcctgtgatttgaaaattcccaaaagttttgtgcataagaaatctggagcaacgatctttaaaatagactccacatatctatcctttaaaataaaatagttcatgctcaaaaaaatccagcactatttggaatatagggtttaaattttgatacatttttttcaattttgttttgagctttattttctaaaatgatctaaagaatcatttcctttgacttcttcccactatgcagggaagtaagactttgaagaagtatatggcttattcttgttctttaacattcaaatgtggctcttatccccactatatctaaacactttttatttttatatgtacacctcattaagtagatagtaagtactcttaaatgaagcaagacaccagtgcagtctctttattccttcacgtgactaatatggtcttgccacatggtatatgtgaaatcaatacacttctcaatgcttcttgtttatagaaaatcctcactttgattttattgtttgattcttttatgttctcttattttttttcacttcaatttgtcttttataagtgtcttgagtattcttacggtatcaagttgacaagtactagcattcaagaaattatgcaatctgcttttgtatgactttgtttgtagagccctaatgaatccatttactcatctattctattcttccatagaaatttattaaggatccactctttgtcagtcatggtgcttaacactaagcataaaaaattttaaaagacagaagttctctgtcctcccagatcatagatgaacaataaacaggtaacaaatggaaggattgattcatcattgcaaggttcataagctgggtatcatcatggagaatagaaaaatacaggtatctactttggatacagttttcagaagggggctctctggagcagtgacattaatttggggcaaaggatgagaagaaaccagccaagacaaagcttggcagaaagcaatcccggcagagggaacaattatgccaaaagcactatgtgggaagtaagtttagtggccaaggaactgagagaaagataaatcatactgagctttggggccataggaggtagactattacagtgagaagactctgaggttttgttaagcagatgagtgagtgagattaatgtttacatcagttacacttgctgctctgtagagaatgaataggagaggcagagagggagagaacttaggaggctgagagagcagcctcagttagaggttgtgaaggctttgacgaggctccaggggaaatatttttatgtttctgcacattcagggctttttgagtaaattttactggaacttgagacatggccttaaagagtaagatttggaagttaaattgcaattgattgaataatgatatgccgttcagagagatagtcctccactgcacaattattttatcctcatcttagatacatacatttgcactcacacacacacacacacatgcatatacatttacatttcaaagagtaagaaccaaggagacttcaaaagttgaatttgtttatttaaggagtaaacattttctctccatttctcaggggaggagtgaggacaactttccctctactatataaccactgtgattcatattttcatgattccacatctactatacagatcctgccttgtacgatgacatctagctctccaagaatcagagcaaagaatattcagtgaagtttgctatgaataataactaacctgtatgtgcctcaggaaacatcatgtttacattcataataatattactaaatatagatgttaaaaacttagcactgtgagaagggaggcaagatggcaaattaggcatagccaagaagagcttctcccaccaagagaaacaagaccatcaagtagactagcatattcccaacagatctttgaaaagaaggcattgagagtggatagaaagaggatacagacctggggctgaagcaggaggaagctgaaaaccctgcaaggggttgctgagcaccaggactcattttggccccaagcagctcccagggaaaaggtgagtttgaataggcatagagtggccccctctcatcacagacctccagaatcttagctgcagcagactacatgattctcatggatatttgagctggcagggaactgcccagagagttgatggagacagaattgtagcctgtgtagagcccaaagagtttgacatgggaacggctgcagtggatcataaccttaggatcccatcctccaaggcttgccatgctcctctaggtggctttagcctgtgttggctgctaaacttggacagaacagtgctatcttgtccatgggatgtggccaatatgatatgagtacccctctgtcttcagatctattatggggtccctggctgggtgtatctgcttgcagcgcagcctcagctgccaagccaagatgcttaccggcagccatcaccatagctcttttcatggcagacctctcctaacagttggatagcttctgtaagtgggcatccaccagctagtacccatgcacagccttcccccatcggcgtgcactcgcctgcagcctcctcctgctgcttttcaaatggatacatgcacatgggtcctgccatcacctaccacccccgcactgaagcacttttgccagcatcccccatcggagtgttgttgcaagtggactgggaacaccttgggtcctccagtgcaggaagtgcataacctcgaggggccagagaaaaaagccgtaagactggtcccagtccttcagggttagagcacaaatcctaggattgctgagctgagccttgactccgtgaaatcatccagaaataaagccgatcatctaaattcgacttataccacagccaaaagcaaaaagccccatccaaagtggcaattttaaagattaaggacacttcagcccaaatagatgaggaagaaccaacataagaattctggaaagtctaaaatccagagaacctccaaacaactatagtagctcccagcaatggttcttccatagactaaaatggctgaaattacagacataggattcagaatctggatgacaatgtagattaatgagattcaggagagaaatgaaacccaatccaaggaatctagggaatccagtgaaatgacacaagcaacacaagagctgaacgatgaaatagccattttaagaaagaactgaattgatcttctagagctgaaaaactcactacagtaattgtacaatgcaattggaagtattaacagaatagaccaagctgaggaaagcttctcagagctcaaagaccacttcttcaaatcaactcaaacacaaacaaattaaaaaaataattttaaaaaatgaacaaaacctctgggaaatatgggattatgtaaagagaccaaatctatgattcattggcatcctagaaagagaaggagaggcaagcaacttgtaaaacatatctgaggatattgtccacaaaaattttcccaacctcacgtgcaaatctagaaaattcagctaaattaaatgagatgctatacaatatgaccatccacaagacacgtagtcatcgtattctccaaggtcaatgcaaaataaaagatattaaaggcagctagagagaaggggcagatcacgtacaaagggaaccctatcaagctaacagcagatattttagcagaaactttagaaactagaagagtaatgcctatattcagcatccttaaagataagaaatcccaaacaagaatttttttattcagccaaactaagcttcataagcaaaggagaaataaaattctttttgaataagcacatgcttacggaatttattaccaccacctgcccttacaagaagcccttaagggagtgctatacatggaaatgaaagaccattacttgtcaccacaaaaagaagtatacagcccactagactataaagctactgtacaataaagtctacacaacaaccagctagcaacagaaagacaggatcaaatcctcacatatcaacattaaccttaaacccaaatgggctaactgctccacttaaagggcaaagagtggcaaacaggataataaaacaagacccaactgtatgctatcttcaagagacccatctcccatgcaatgacacccataggctccaaataaagaaatggggccgggcgcggtggctcacgcctgtaatcccagcactttgggaggccgaggcgggcggatcatgaggtcaggagatcgagaccatcccggctaaaacggtgaaaccccgtctctactaaaaatacaaaaaattagccgggcgtagtggtgggcgcctgtagtcccagctgcacgggaggctgaggcaggagaatggcgtgaacccgggaggcggagcttgcagtgagccgagatcccgccactgcaccccagcctgggcgacagaacgagactccgtctcaaaaaaaaaaataaaaaataaaaagaaatggagaaatatctatcaagaaaatggaaaacaaaaagagcagaggttgctattcttatttcagacaaaacagactttaagccaaaaatgatcaaaaaagacaaagaagagcattacataatgataaagggtttaatttgacaagaagttttaactattctaaatatttgggtacccagctctggagtactcagatttataaaacaagttcttgaagacttagttaactacactgtaacagtaggagacttcaacactccactgacagtgttagatatcatcaggcataaaatgaataaagacatttaagacctcaatgcaacacttcacaacatggaactaacagacatctacagaacaatccatccaacagtaacataatatacattctcatctgcatatggcacataatctaaaatcaatcatatgcttggctataaaggaattatctaaaaattcaaaaaatggaaatcatacaaagacactattggatcagagtgcaataaaaatagaaatcaataccaagaagatctctcaaaaccatataattacatggaaattaaacagcctgctcctgaatgactttggggaaagaatgaaaataaagcaggaattaagaaattatttgaaactaatgaaaacaaagatatagcataccagaatttctgggacacagttaaagcagtgttaagaagaaagtttatagcattaaatgcctacatcaaaatgtcagaaatatctcaaattaacagttctaacatcatatgtagaggaactagaaaaacaagagcaaaccaaccccaagcctagcagaagaaataaccaaaatcagagctgaattgaatgaaacttacacatgaatccataaaaaagataaaaaaaaagttgatgttgtgaaagcataaataagaaagacaattagctagactaataaagaaaaaagagagaaaattcaaataaatgcaatcagacatgacaaaggtgacattaccactaaccccacagaaatacagaaaatcctcagaggtttttatgaacaccgctattcacataaactacaaaacctagaagaaatggataaattcctggaaacatataacatgctaagattgaaccaagaagaaacagaatacctgaacagaccaagaatgagctccaaaatggaatcactaataaaaaatctaaccagaaaaagccctggatcagatggattcacagtcaaattcttccagatgtatacagaagatctcataccaaatctatggaaactattcaaaaaatcaaagaggaggtattactctgtaactcattctatgaggccagcattgttttggtaccaaaacctgacacagacacaagaacaacagcaaaagcttcaggccaatattcctaatgcatatagaagcaaaaatcctcaacaaaatacaagaaaatcaactggagcagcacatcaaaaagctagtccaccacggtcaagtaggctttattcctaggatacaggattggttcaacatatgcaaataaataaacgtgattcatcacataaagagaacttaaaaaccacatgattatctcaataaatgctgaaaaggcttttgattaacattccacatcccttcatgataaaaaccttcaacaaactgggccttgaaggaatacacctcaaaataataaaagtcatctatgacacccacagctaaaaccatactgagtgggcaaaagttggaagcattcccctggagaaccagagcaagacaagaatgcccacgctgaccatttctattaaacatagtactggaagtcccagccagaataatcaggcaagagaaagaagtaaaagtcatccgaataggaagagacgaagtcaaaccacctgtctttgcagacaatatgattctatacttactaatttccatagtctctgcccaaatgttcctagaactgataaacaacttcagcaaagtttcacaatacaaaatcaatacatgcaaatcaggagcatttctatacaccaataatgtccaagctgacagccaaattaagaacccaatcccgttcacagtcctcaccaaaagaataaaatatgtaggaacacagctaaccaaggaagggaaaaatctctacaagaagagttacaaaacagtcctgaaagaattcagagacgacataaacaaatggaaaaacattccatgctcatggataggagtcaatatagttaaaattgtcatacttccaacagcaatttacagattcaatgctattcctatcaaactaccaatgtcatttttgacaaaattagaaaaaagctattctaaaactgaaaccaaaaaaggagcctgaatagccaaagcaatcctcagcacaaaaaaaaagctggaggcatcacctgacttcaaactatactacaaggctacagtaagcaaaacagcatggtatttgtgtaaaaacagacacatagaccaatagaacaggtcagagaaccctaaataaatctacacacctgcaaccatcagatctttcacaaagctgacaaaaacaagcaatggggaaaggactccctattaaataaacggtgctggtataactggctagccacatgcagaagactgaaactgggcctcttcctttccccacatacaaaaatcaactcaagatggattaaagacttaaacataaaacctaaaagtataaaaattcctaggagaaaacctaggaaatactattccagacataggccttggtaaagatttcatgacaaagaccccaaagcaatggcaacaaaaacaaaaattgacaaatggaatctaattaaactaaagagcttctgcacagcaaaagaaactatcaacagcataaacaatctacagaatgggagaaaatattctcaaactatgcatccaaaaaggtctaatatcaagtctatagagaacttaaacaaatcaacaagcaaaaaccaaacaatctcattaaagaagggcaaaggacatgaatagacacttcccaaaagacgacatgcatgtggccaacaagcataggaaaaaatgttcaatatcactcattagagaaatgcaaatcaaaacagcacaatgaaataccatcacacaccagtcagattggttattattgaaaagtcaaaaaataacatgtttgtgagggtgcagagaaaaggaaattgttatacattgctggtggggatataagttagtttaaccaccatggaaagcagtttggatattctcatagaaatgaaaacaatctaccatttgacccagcaatctcattactgggtacttacccaaaggaatgtacatggttctgcattaaagacatttgcatgcatatatccattgcagcacctttcacagtagcagggacatggaatcaaccttgatgcccaccactgttaaacagcataaagaaaatgcagcatacatacaccatggaatactacagagccatcgaatgaatgaagtcatgtcctctgcagcaatgtggatgtccctggaggtcattatcttaagcaaattaatgcaggaatagaaaaccaaatactgcatgttctcacttatatgtggatgctaaacactgagtacacatgtacacaaagaggggatcaatagtcactgggaattacttaagggtgcagggtgggaggagggtgaggaccgtaaaactacctatcaagtagtatggtcactacctgggtgatgaaatcatttgtacaccaaaccttactgacacacaacttacctatgtagcaaacgtgcacacgtacccccgaacctaaaaaaaagaaagagttggaagaaagaaaaaaaacactgtcattggagatgacaaaaagttgaaaaaattaaaatatatttgtaaagagattccaaaaaaaaaaaaaaaaaagacctttctgatggattaaatgagggttgggggacaaaagaaaggagtcaatgatcactccaagttttattgagatgaggaaagactgagggaggaggaggttgtggataaaacaataaaattctgttttggtcaacttaagtgtaaaatatatatgaggcataacatcaagtttttaattatgcaattggatgtgcatatctctggctagaaaaaaaatcaacttgaagtcacactttcactcttttgtctcactgaaggctataattcacaagcatgttatgcttcctaaacgacagagctcagtgactactccactagtttaattgactgaagaggactgaaagaagataagaattccagaactagctcacaaactagtcttttgacattgaaggtgttagactggaaaacagtgaatatcttaatcaactctgtaattctgtgattctaattattttttaaatttttttcattaatgaatccatgttggttatataacgcaagttgcaactgtatccaaattgttcctgtaaagttaaactcaatctagtagactttctttctaagaagaaataatcagccaaagtttgcagacatcaacagttctggttaaaaaattgcttctaagaaaacacctcaatatttcactggtcttcaataactattacaatcaactattattctgatagttgactggcataactgagtagttctcatttgatttattgtgtagttgcattctgatgatgttttgagctgaaggcatctgaagatatccccagtcacattttcagtgcctgggatagaatgattagaagagacaggtgccagttggtcacctctccctccacctggccttttcatatagctagcatggatttgctaacagcctggggatctccagacagaggcttctttcatagaagggagaagctgcagtgactcctcttatttagtcacataagtcacacagcattaattttataatattttactgatcttaacagtctttggcccctccacattcagggagttttgagaaataaactccatctctgagtggcagaatggctagcttcgggaggggtggagaggattgacagtggttatcttggaaacaatctagcacatccctctgatcatcatctggtttgaatgaaaaacaatagttttttcatatctcagcctccagtcaggggtgctgaccagatggaataattagtgggctgctaaccagaacacatgttctaaggaagaatgtataaggctgattctctcatccagctgtgactcatacctctaaaaagcactccgaggctggcatacctgacagcaccctactttggtcatgtcctctcccatctccatacgtgctagcaccttcaatgtcaaaagactgattagtgaggcagttctggaattctaatctttcagacctcttcagtttaattaactagtggaggagtcactgaacaagtaggaagcatactatcttgtgaataactatagcctgtggtgagataaaagagtgaaagtgtggtttcaaattcccttaagactataacacattgtaatttttttttctagccagagatgtgcacatccaattgcataaatgaaaacttactgttatgcctcataaacattttacaagaaatggaaaccctaccatatttgcaatctgacctcccttgtggctaatcatggtttttccacttttatatttttgagaattctagagcacagaatctccccagtctactcaagaacagtagtccttaaactgtggtttgggtacacatggcaatacaggaaccgatggtgatacaggtaaccatggtgacacagaaaatcttctcatcagggtaattgcaggaagagttttaaaggaatccatttccagatccttaacatccatatgtgctctttgtcaaatttatctgcttgagaatgaaccagcattaatgaattctttcttttaatttaccaaaaataaataaatgataaactaacaaataaataaagttcttcacccacgctaaatcttacagtgatgttgtaaaatccaccagggcttcgaacaaagaagaaatggaaatgttggcttaaggaacattttagtatttaatttcagaaacataaatatgcaggatttcctgacttgatatgtattttggtgggggacaaagcttgctgtaaggtattttggcctatttgtcggtgctgtaaactcacatagcttaagcagcataagttagtgattctttgaaatgtagttggaatgctttaaagaaccatcatacatttcaaagtacattgtataaaacacatgggtaaaattttacataatgcatttcaaatattgtgtgtttaactcaatacacaggtgaaatcgtttttcaaattacattataaaatgttcatcccagttatatacattcatattatttcatcttgtaatagtttctgggtatcataaataagttatattaatttagactcataatgaaaatatttagatgtcaaattaaaatgtgtagagaatatgtagttttatcaaaattctcttaagggttgtataaactaaatgaaatgctacttatgctctatttcttatcactgtattcatctggctttattgaattacttgttattagtttgacttcacctttggaccgtaggtcacattactgcaaagataatatctgtctattatggctgtatccaagatacctaccacaaagcctcacattactagacattcaatgagtgaattgaatataagcatgaatgaatgagtgagtgcatgagcaaagcagcaggtatataaaacacagcagccttttcccttgtttaaacttttattgattattttctgagccacctactctactactttttgaggtttaatgcctttatcataatattatgtcatctattttgcaaagtgctataatcatattagctgaagagtgtatatgttaaatgctatttgactatttgactttttaaagagcagttatattgagatataatttacataccataaagttagcccttttaattttcagtgtaaaatttaatgtaaaattcagtggtttatagaatactctcagaattgttcagtgatcattactatctaattttagaacactttcattacctgaaaaagaaaccttatagcagcagtcacctccctctcagtttatgcaaccactaatctctgtttcatagctttgcctattctagacatcttattttatttacttatttttgagacagtttcactctgtcactcaggctggagtccaatggcatgaactcagctcactgcaacctccgctttctgggttcaaacgattctcctgcctcagcctcctgagtagctgggattacaggcatgcgtagccatgcttgttaatttttccatttttagtagagatggggtttcaccatgttggccagactgacctagaactcttgacctcaagtgatccacccgcctcggtctcccaaagtgttgggattacaggtgtgagctacagtgcccagcctagacattttatataagtggtactacacagtatctgatcttttgtgactggctctttcacttagaataatactttcaatattttttttcatgttgtaccgtgaatcaacaatttgttttttaaaactgatgaacaatattatattttatggatttatcacgttttgttgatccattaatcagttgatggacatttgggttgcttctacgttttggctactatggctaatgttgctctgagcatttatgtacaagttttagagggacatatgtttctatttttcttaggtgtatacctaggagcagaattattggtttacatggtaactctgtttaacaatatgaggaaccaccaactctattccaaattggcatcattcatgagtatatttttatggacttaatgaccatttataacacctttttgggggaattgttaattcaaatcctttgctcccaaaattggactgtctttttattgttaaattataagagttctttgtacattttggatacaagtctgtcatcagatatatgatttataattttttttcccattctgtattttttttcttttttcttttttttttttagacagagtgtcactctgtcacccaggctggagtgcagtggcgcaatctgagctcactgcaaactccacctcccaggttcaagcgattctcatgcctcagcctccccagtagctgggattacacgtgtgcgccatcacgaccagctcatttttgtatttttagtagaggtagggtttcaccatgttggccaggctggtctctatctcctgcctcaacctcccaaagtgctgggattacaggcgtgagccaccacgcttggccttttttccttttttttttttttttttttttttttgacagagtctcactctgtcgcccaggctagagtgcaatggcgtgatctcagctcaatgcaagctctgccacctgggttcacgccattctcctgcctcagcctcctgagtagctaggactacaggcgcccgccaccacgcctggctaattttttgtatttttagtagagatggggtttcactgtggtctcgatctcctgacctcatgatccgcccgccttggcctcccaaagtgctgggattacaggcgtgagccaccgcacctggcctttttcactttcttgatggtgtactcaatagcaaaattttagacaatttggatgcaatacagtttacctatgttttcaattatccctcatgtttttggtgtcatatctaagaatattatttaatttgttttttatttttatagagacagggtcttgttatatcgccctggttggtcttgaactccttgactcaagcagtcctcctcccttaggctctcaaaatgctggggttacaggtgtgagccactgggcccagcttgattcttaataattattgttgaaaataaatataagcattgccatgctgattaacttgctttctgtggctgccctcacttacaatgcaaattttacagactcctctagacatttagctggaactgccatgtgttttccctaaaaccagctcataatagagctgggctcaccataaatccatttcctactattcggttgagatctgcaggcacttttactttgtaaaatggtcttgctcacgcctgtaatcctagcactttgggaggccaaaggcaggtggattgcctgagctgaggagtttgagaccaggctgggcaacatggcgaaaccccatctctctgaaaaacacaaaaattagtcaggcatggtggtgtgtgccgttaatcccagctactctggaagctgaggcatgagaatcgcttgaacctgggaggcagagtttgcagtgagctgagattgcacactgcactccagcctgggcaacagagtgagaatctgtctcaaaaaaaaaaaagaaagaggaaaaagaaggaaaaaaaagcccttaggggaacataagtactgagagtcttagcaagcaaagaatacatgttttgagatgaaattgagggaaaatagagagtatagtgtatttcggaaaaggaaataagactggtttgttggaggacacaccagcatgatctctttcttattatccttgggatagatttcccaaatgatattctagcccctcagggcaacaacacaaaacacagcaaaaaaaagacaaaaaaacaaaaaacaaaaacaaaaacaaaaaaactcacagcatttacaggagtaaaactaattgtaatcatatgattcaaaagagcagtgcttttatactttcatatgtatacagattacctgttaaaaacataggttggctgggcacggtggctcacgccagtaatcccagcactttgggaggccgaggggggctaatcacgaggtcaggagtttgagaccagcctggctaacacggtgaaaccccgtctctactaaaaatacaaaaaattatctgggcatagtggcgggtgcctgtagtgccagctactcggcaggctgaggcagaagaatcacttcaacctaggaggcagaggctgcagtgagccgagatcatgccactgcactccagcctgggcaacagagcaagactctgtctcaaaaaaaaaaaaaaaaaaaaaatcagtcaggtagtgattaagcaggtatggaatggggtcttcaaaagcctacatttttaacaagctgcaggtaatgatgatgctgttggtcaggaaccaaactttaaactttaaataccaaagttgtggaaggcagaagggagcaaagagttcattccctccttcagaaggggagaaacattcactttgcaatcaggctgtgtttatcgagatgactgacattttttgcatgtgttcagacttaaaggtcagatctgtttccttctcagcagctgcgtgggaattgcttatctcgcactttctgtatggggtttgattacctaagtgaaccaagaagtttcacaatattttggagaaaaacacttctagtagcatccaacatgcaacattttaaaccagctatgaaatggcaggcttacaaagtcaacttggaatcacatctctggtccaggcaaagggaatgaaaacccagagactatctccccgagagccctgtagctgtgtgtgaatgtgtacgtgcagggatatggactgtagaccctgttacaaatactaaatatctgtttggaagaaggctgtcctcacatgtgccgctaaaatcatccacaggctagtcttaggccaaacggtaaaaggaaagaagcctatccttggcaattattcaagcagacagtctgacaagctttcctgagtgtctagtacatactaagcacggtattcatgtcccaggtacagagattaacaagtctctgatccccaatgcacatggcttgatgggaagtctggcattgaaatagacaattgcaacattgtaacgtgtgtggtataatagagatatacacagactggagagaggtccaattcagcctctggaggcagaaagctcaggaataacttctcagatgtgatgcttgaatttgttgcccattttttttatttttcctcccaagtgcctttataccatttaagggactcttctgcaaagaagacggaatttaaggtaacttcttcacttggtgttattgatggtggcatatgatacttggtccagataacgggcctgaatttccaaaggtattcaccactgcgagctattcttaaaatctaagaatgaattgacaataatagagtttcacctactaggaagacagatcatttgggggctagagtgcttatgttccagtccttaaaagtcacatcgctggaatgactcctgatgtttgtcagaagctggatcagatcacaaaagcccttccttggagcaagaggcctccgccaggactgagctcatttacttgacctgaccctgaatttccgtagtggagacaagcctcaggaaaatactaactgcctgctgtgttcccatactacaaaagagtgatctgtagaagtgacaggtactttccccctctgggagagaagggtccatgtgttctcctgcctggaccctctagcaagctacttaatatggaatcacacccctggaggagataggcaaacccttgaacagccaggtcaaatctaaaaggcaactgcctctagctgcagaggcaggtggcagcttaaagtggcaccaagtcataaaatgatttcccttttgagcttgggggaagatacaattttttttttttttttttgagacagagtctcgctatgtcccccaggctggagagcagtggtgcgatctcggctctctgcaagctctgcctcccaggttcacgccattcttctgcctcagcctcccgagtagctgggactactcgggcccccaccacgcccagctaattttttgtatttttagtagagatggggtttcactgtgttagccagaatggtctcgagctcctgacctcatgatccacccacctcagcctccaaaagtgctgggattacaggcgtgagccaccgcacctggccaggggaagatacatttttaagcagcattccaggctaatatgggagtacatggatgcaacactgtatctcatgctggattagcagccctggaaaccagagctgtctcttaatcaagactaggtattgtgaacccaggtaatctgaggcaggtctcagttaatttagaaaggtttttttttttgccaaggttgaggacatgtccatgacatctgcccaaggttgtcagggcatagcttggtcttacacattttagagagacatgagacatcaatcaatatatgtaagaagtacattaattcatccagaaaggcagagacaactcaaagcaagcctccctccccaccctgagggacttctatgtcacaggtggatgagacacaaatggttgcattcctttgtgtttctcataagtctttccaaagagggcaatcggaatatgcatccatctctgtgagcagcaggatgactttgaatagaatgggaggcagatttgccctgagaagttcccagcttgaaagggcccaagacattttcctttcacagtatcttagtccattttgtgttgcaataaaggagtatctgaagttgggtaatttataaagaaaagaggtttatttggctaatggttctgcaggctgtacaagacgcatgacactggcatccatatgctcagctgctggtgagggcttcaggctgcttcaacttgtggcagaaggcaaaggggagccagtatgtgcagagatcacaaggcaagtagggggagtagggggaggttctaggctctttttatcaaccaactcttgtgggaactaataagagtgagatttcaccaaccctccccaccagggaaggcattaaggtattcacataggatccacctccatgacccaaacacctcccatgaggccccacctccaatctccaacttatgaggtttggggagacaaacatccaaactacagcattttgcccctggccttccaaatgtccttctcactttgcaagataaaatcatccctctccaataggcctccaaagtcttaacttgttccagcatcaactcaaaagctcacgttccaaagtctcacctgagactcaagacaagttccttagagctgtgagctgtaaaatcaaaaataagttatttgctttcaaaatacaattattgtacaggcattaggtaaagattctcattccaagagggagagatgagccaaaagaaagggataacaggccccacacaagtctgaaaatcagtagggctgacattaaatcttgaatctccagaataatctacattgactacatgtcccacatcctgacacactggaagaagaggtgggctcccaaggcttagggcagccctgaccccatggctttgctgggtgcaatccccctggctggctgctgtcatgggttggagtagaatgcctgtggcttttccagcctgagggtacacggtgccagtagctctactattctggggtctggaaggtgatggttctcttcctgcagctatactagatgtggtcctagtacaggctctcagtggtggctatgcttctgcagcaggcttttgcctgggcaccacacattcccatacatcttctgaaatctatgtggaagcctccaagctttcaccactcttgcattctggacatctacagacatagcacgaggtgtatgcttccaaggcttcctgcttacacaccccagagtggcagcctaagccatgcctggggctctttgagctacatctggagctggaacaacaggagctatcgggggaaccagcccccaatatttcaacgtaggttcttttctattttccctaagtgtcagctggtctgagaaataaagagaaagagtacaaaagagagaaattttacagctgggcctccaggggtaacatcacctattggtaggttctgtgatgccccctgagccacaaaaccagcaagtttttattagggatttcaaaaggggaggtaggtacaaacagggagtaagtcacaaagatcccatgcttgaacggacaatacaagatcacaagggcagagaggcagagcaagatcacaaggccagggcgaaattagaattactgatgaggttccacgtcctgctgcgcacgcattatcattgataaacatcttaacaggaaacggggttcaagagcagatgaccagcctgactagaattcgccaggctggaatttcctaatcctagcaagcctgagggcattgcagcagaccagggcttatttcatcccttgtcttcaaccgcataagacagacactcccagagtgtccatttagaggcctccccctgggaatgcattctttcctagggttattccttactgggaaaagaattcagagatatttctcctatttggtttctgcaagaagagaaatgtgactctgttctgcctggccccataggcagtcagaccttatggttatctcccttgttccctgaaaatcgctgttatcctgttcttttttaggatgcccagatttcatattgttcacacatgttttacaaacaatttgtgcagttaacgcaatcatcacagggtcctgaggcgacatacatcttcagcttacgaagatgatgggattaagagattaaagtaaagacagccataggaaattataagagtattgattgaggaagtgataaatgtccatgaaatcttcacaatttatgttcagagactgcagtaacgacaggcataagaaattataaaaatattaatttggggaactaataaatgtccatgaaatcttcacaatttatgttcttctgccacggcttcagccagtccctccgttcagggtccctgacttcctgcagcagggagcagtatcccagggaggcacaggaaattggaaccccaaacatgtccccagaatctattctgtcctcctaagcctctgggcttgtgatgtgggggcagcctcaaagatttctgaaaagcctttttgacctttttttctattgtttgactattagcacctgactccctttagtcacgttcatctcttagcaagtggttttactgcagtacccttggatttctctccttaaaatattcttctctaccgcatagccaggctgaaaattttctaaatatttactctctgcttcctttttaattataaattccatctttaggtcatttcctcgctaccaaatcaggttgtaagcaattgaaagcagccatgtcacttcttgaaggctttgcaccttagaaatttattctctcagataccttagaacagcattcttaaatttgtcctttcattaatcccaagggcataaatgcaatgcaggaaagttctttgctaaggctaataaggatgacctttgctttactttccagtaagttcctcatttccatctgaggtgccatcagcataacttttactgtctatatttctatcagaattttcatcacaaccattgtcttagttcatttgtgtttctataaaggaatacctgaggctgggtaataaattttttaaagtttatttagcttatagttttgtaggctgtacaagaagcatggcagtggaatctgcttctgacgagggcctcaggctgtcttcaatcacagtggaagatgaaatggagctgttgtttgcggagatcacatggtgagagaggaagaataaaagcatggagatgccaggcccttttccacaactggccctcatgggaactaatagagtgagaacttattaactactgcaagaatggcagcaagcagttcataaaggatttacccccatgtctcaaacacttgccaaaatgctccacctccaacaatggggaccaaatgtcaacatgaggtttggagaggtgaaatctccaaactataccaaccacttaatgaatctctaagaagtttccaactttctcttgccttattgtgttttctgagtcctccaaaatcttacagcctctgcccatcaacccgttccaaaaccacttccacatttttaggtatctttatagcaacatctcattccttggtaccaattttctgtctttgcttgtttgtgttgttataaaggaatacctgaagctgggaaatttataaggaaaggggttttgtatggtacattgttccactgattgtgcaagaagcacagcactagcatctgcatctggggagggcctcaggctgcttccactcatggcagaaagtgaagggaagccaacatgggcagagatcacacactgagagagaaagtaagatgcagtgaggccatgccttgctctttctaacaaccagttctcatgggcactaatagagggagaactcattaccatgaggactgcactgagccaggccaagtcattcctggggtgtccgccccaatgactgaaacacctcccatttggccccacctccaacatcaggatcaaatttcaacatgagatttacggagacaaacatccaaactatagcactgggtaactgggtggcaaagagtgtgtatgattggagtagaataatcaggggacttaggagtatagaccaacattagaaatctgctgccatttactaactgcctgtcctttgacagtaagttaaccaagctgcatgtcaggatcttctgtgaaaaaaaggagtaatagctgcatcagttaaggttgcccagtaaaatgttggaggtccagttaaatttaaagttcaaataaagaacaaataactttttcacataagtgtactccaattgttgcatgggacataattatacaaaaatttattcattgcttttgaaatccaaatttaacagggacattgcctttctgttcgctaaatctgacaaccttagagttcatcaggataggctagtttaagccaaagtaatatttagttttagaatcttgctggcaaattctattaaacaatttgttgttcattaagtgtcgtccccagaaaagcagcatctgtgtgtcctagaaacatcggaaatgcaattttagacctactgaattagaaactatggctatagagccaggcaatttgttttatcaagccctccaggtgactctgatagactaaagtttgaaaactactgcacacatttgcagaacatctaaaagctaaacatttttctgtcctgtagcccaacaatttcatgactaagtatataccaagagaaatgagtgcattattcactaaaatatatgaatggagttttcataacagctttatatacatcatggcccatggctgaaataacccaaatatacatcaacaggagaataaataaattgtggtacttagaacatggcacaaccctaaaaagaacaaattttttatatgtgaaacaatctgggtgaaaatttacagacaatattttgagtaaaagaaacacgacacaaaagaatatgtatgttctatgtgattttatttatatacagttcccagatcaggtgaatctaatctattttaatagaaatcagaatagtgtaactggggttgggatgggtggctgtattgactgggaagagaaatgaaatcttccgaggtgctggaaatgttgtacatcttcacctggttatggttatactggtgtatttagatgtatacatttatacatgtgttcatttaagattaatacaccttatatatgttatacctcaaaaagagaaaagaaaaaataactaatgaaacaaatctcagtgcctaaaagaataaaaaagtatgcctcactcctactacttactactttaagcttccatcacctaacccggggcaatcatttgtgtggccttatctatctttaagtgggaaaagcagtacatccttcatagagggagaaagagcagaatagttatgaactatcttactgactccaacacacctacttcttgaagttctatgtaatagacatagtctcatttattcatcctctttttttaaaaaaaacttacactatgaacaaagcactatgttagccatgtgagattcagtgataaaataaaatggtgttgctcttagggagcttatattcaaagaagaaagacattaaaagagattacataaataactagttagaattatgatagatccagtaggattttgaccacttgccttcatcattttcttaaggcattggtgctgcctgggtacctcttttgcaaccaggcaacatcagccaagatatgcatgacacaatctgaaacatcctttctcaccctcttcaacacctcagcagctacatgagccatcaccagttcataaacggggtaaaaagtagaactgtcctagccagtagtttagtggaagacactgagattctaaactgcattagaagctgaatgcaaaattcaaaatatttcagcaggcaaaagaaagtcaaacagggcttaacattcactactggtcctctgaaagcccatgatacaaccaactattgcagttgattgactaaatttgcaagagtagaagaaagagaaatgtgaaggcagaaaagcaacagcaacaataaaaagtatcaaagggtgagagctatatgataaaaataactagaagaatagccaaacatttggaagagaggttctcttacttggtcatccatcagaattgccttggggactgtttacaaaggttgtcgggccctacccacagaatttctgattcagtagatccagagaggggcctaagaattttcaccgcaataattctcaggtcatgctggtgtcgttagtcaccacacattgagacattgctgaacacacactgagaattgctgatctagaggaaggaaggaaatgtaacactgaactgctctcactttccttctattttgaacaagctgctattattctgaaacagaaaacttagacgttctgcctactaatgctattattttttcaagttcaccattaaaatgtagggatgtggtaacagctgtgaaacctcttgcactacactgggtcttccttgagtccactacaaagaaataaatcagtgactcttttcttctttattcttcagttgacccttgaacaaagaaagggttaaggatgtgaagttcaggctcatctctgaggtaaaaatccaagtataacttttgactccccaaaaacttaactactaatagcctcctttgactggaagccttaccaataacataaacagttaattgacacgtgtattgtgggttacacttattgtatactatattcttacaaaaaagtaagctagagagaagagaaaagaaaatattactaagaaaattataagaaagagaaaatattcttactacacattaagtgggagtgaaacatcataaaggtcttcatcctcatcatcttcatgttgagtgggctgagaaggaggagaggaggggttggtcttgctgtctcaaggatggcagaggcagagtaaaatctacaaataagtggacccctgtagttgaaatctgtgtcattcatgggtcaactctgtgtgcgtgtgtgtgtgtgtgtatgtgtgtattaattcggtttagactacaaagggcaacccgctctccaggaaccaagactgatgctggatgatgccatatatacaagatggcatataggaggtgatcatggaggaccttcagtagcagaggctaggaaccacagggttgaggggaggaggtaagtgaaataatggggctaggctagaatagaaagtagtatcatagcgttcatttttatattgcaaatatcttttctctgtgcccttataaaataatatttaaatgtgtttttaatcagtcctaagtaattggcaaattattacatcatcatcataatcatattttctcattcatggaaaagatatttactgagcctttaatgaatgccaatcactgtgcaggttttagagattcactcgtgaatgaggtaaatctactccatgtacttaactgatagagatttaaaactatactcatgtaaccatgtcattcattcccctgtcaggacaaccccgctgcttcccattttcattcctctacatttaattacaacccggtcttctactctaatctctccctgcgatcttgatctatgagatacttgccccttcgtcatcgtttcccttctgttgaaagcaaacctcctctcaatgcctgtaagccccattcaccttatccattctataaggatcatttcagcccttatttttactgaagcctcttacctccactttagtccaaagtcggaactctttctaattttctgtaggacctaatgtgcccattaggcatttaaatgtacacattcagtattgaatttttattgagccatgttatgtgtaagtagtattgtccctttgcaattttcatctatcagaattatggataagatttgctgtcccttcataaaattgtgtttccatggtagtgtcatttaaaggtgaatcattttctcataggaactatgagtgcaatttggtggctgccttttaaaaaataggctaattcagtcattctcaaatgcagtcttgatcagaaatgatcctttcggttatttgctcaagtgtgtgtgtgtgttcaggtcccaacccaagaccaactatctcagaatttccaggtaatctcagaattttgagataacatggcctgaggatctatcttttaaacaagtgcctccagacaatcttacgaagaagcaagtttgggaaccttctggctgcacattaaactaaaaaactgaaggtttttttttttttaaatcagtatcctagaataattaactcaaaatctccaaaggtgaggttttcctggcatattttcttttctatttttacatctttctgtgacatttatttatttatttgttttaatttattttttatttcaataggttttgggggaacaggtagtgtttggttacatgaataagttctttagcggtgatttctgaaattttggtgcacccatcacccaagcagtgtatactgtacccaacatgtagtcttttatccctcacctgcttcccaccctttccccaagtccccgaagtccattgtctcattttatgcctttgcttcctcatagcttagctcgcactttaagagtgagaatgtacaatgtttggttttccattcctgagttgcttcgcttagaataatagtctccaattccatccagttgctgtgaatgccattattttgttcctttttatggctaagtagtgttcgatagtgtatatatatatgtgtgtgtgtatatatatacacatatatacacatatacacatatatacatatatatgtgcgtatatatacacatatatacgcacatatatatacataaacatatatatttttttatccactagttgattgatgggcatttgggctggttccacatttttacaattgcaaattgtgttgctataaacatgcatgtgcaagtatctttttaatataatgacctccttcctctgggtagaaactttgacatgggattgctggatcagacggtggatctacttttgtttctttaaggaatctccacaccttttttcactgtagttgtactattcactatacactattacagtgtagaggtattaactttttactgcatccatgccaacatctattattttttgattttttgattatggccattcttgtaggagtgaggtgttatcacattgtgattttgatttgcattttcctgatcattagtaatactgagcatttttacatatgcttgttgaccatttgtatatcttctttaaagaattgtctattcatgtccttagcccactctttggtgggactgtctggttttcttcttgctgatttgtttgagttctttgtagattctggatattagtcctttgtcggatgtatagattgtgaagatttttttctcactctgtgggttgtctgtgaactctactgattatttcttttgctgtgcagaagctttttagtttaagttccatctatttatctttggttttgttgcattggcttttgggttcctggtcatgaagtctttgcctaagccaatgtctagaagggttttctgaagttatcttctaggatctttatggtttcaggtcttagatttaggtctaatccaacttgagttgatttttgtataaggtgagagatgaggatccagtttcgttctcctacatgtgacttgccaatcatctcagcactatttattgaatatggtgtcctttccacactttgttttgtttgctttgttgaaaaaaaagttgcctgtaagtattcggctttatttctgagttcagaaagtgggggatgtgaaggagcaggaaagatctgcaggactgtcatcagggccagactcgctgcccagttcaatcctctggaaggctgcacagatcccacctgtttacccttaaggtttcacgccctcttgaactctctcttcaaagttctttccaactttctcttgtggcactggttgactattggtcttgtgccggtctttagctttaattggagtttaccaccaattaactgcactgggctgcattcccaagcaacctgactccaggaagatctgggctggttcaccttttatggccacactactctgaacgtgcccaatctcttctgatctcggaagctaagcaaggtcgggcctggctagtacttggatgggagacctctgccatattttctaaaagccgtctttgttccgaatgggcaactaagttaagaaccactgcatagtgtaacttatgagcaagattgctgaacagtcagtgaaaacagggagtttagtacaaagtctcttcatgtatatttcctccatagaagatgtgggagaaccttaaattaaaagaatactcaccaactgccaattcatttcttgtaagtaacatatacacatttcagacaaattggaaaactgaaaagtataggaaagtaaataaagtcactcattaagtcagcattccccatgagcactgtaatctatttcatcctaaccattttatccacagactatatacacatctcccaactgtcggtttgtaacaaaattggttttatttttgtgtactattttaacatacctctttctactaatatagaatatgtattttacatgttacttttttctaaaatatgatattaaggaatatccattattaaatgggtataaaaattgtttagctaaaacctatttctgtaggtttttccattataattaatgccaccataaatattggtacatagggttttatatacgccactggtcattttccagcattattgaagaagataaatataataaaacatacaactctttgtcaagtaaccagaagtggattactgagttaatagatgatcaaataatttttattttctcttcagatatatagtagcagcttagcaaaaattcatggagatatctttttccattgctgtaatgaacacaatttattacaaatatattttaattggctaattttccaagtgaaggagttgtacttaatttatttaatttgtatgactaagaagtgacatttttccttaggcatttgtctaattcttccttttgcaaattgcccatttacactttgtcccttttttttttttttttttggtcagaggagactttttgcctcattaatttgtaggaaatccttacttagtaagtaatagtaagcttcttatcccttttttgctctcatcatcatcctcccacttttaaatcttttgttattttttaaactttaatcaaagttattagtccttggggagagatttctagcttttgatattatatttgcttttcttaatccaaattcagatatttattaattcatttactttctaactttcctgtcacttcatatgtatatttcccatacttatgagtgtgtatacagaaatacatatgtgtgtgcttttaattattctagaatgtattgcaatagataaatgtctactgtatactatattcttagaaaaaaagctagagaaaagaaaacattattaagacagttataagaagaagaaaatattcttactagtcattaagtggaagtggaacatcattaagatcttcatcctcatcatcttcatgatgagtgggctgaggaggaggaggaagagcaggtgttgaaaggggggggtggttaggcatcctcttgttcatttttagaaatattcatttccctcagtgctatttacaaaataatttcaactatttcgctaagttgtgtactgcctttattatatactaaattttttaaattcttttttcctccatttactatcttgttttattgacctgtcttatcctgacacctgtttcacattgtttaaattattgtgactaccttaatagatatgactatcgggatgcacaaaacctacctacttttgcttttataataaatttaagcaattttgtgtcaaacttaagatatgacttaaagataatgaaagaaaaacccaagatatagttaaaatctgtcaattttaattgatatcaccaatatttaactgaaattctcctcttaatttttaagaaacttacttcacttttgtccattcatgttgtataaacaccttagaacttgtgttcacatgtctttggataatttctgtgatttcattcatttctcaccctgtctgcttagagggtggctgtggactttacaaaatacttttatttacagctatggctcataccaaatatgttttagtgaaataaatatttgatttcagtttgtatatcttatataaaaatataatccataccaaaattttctagaacacatttattgcacaattgaagcctgttagtctacagtggatcatgaaatacaggcctataataatctaattgctatccatagtaagagactcttctctggtctcttgcagtgtgtgcttatctaccttgtttatgtattctgccaacttctttaagtctgtattttaatccctagcagttgggtaaacattcataacgtgtgtgtaacaattatttctgaactgctctcctttcaaaagcattgataatcgaaggttaatgcacaatcgaattttttccttcctggatcaagcctataactgtaacactgtgaaactctcagaaattgctctattacaccaagaagcttacactgctctttgacacacaacactttggatggtctgactatcttgttatgttccgattgctacagtaatcagttagaggccagacacatgttttattataagagcaaacagagtgtatctgctctagggatcagagagagagaaagataccagatttgacagcagcagacttctaaaaacagactgacctgaaatataaatttctggagctagagtagttagtgttgtgacaatcagtttacatctaaataacagaatctacaccagagaccactcagcaaaaaaaaaaaaaaaatggtgttttaataagattcttgcgggtttgcatttcttcagccaatacacagcatagcaaaccccagatcaagatatgaaactttgtctttaccttgtgttgagagaatatcacttaggtggaaaagaaatgaaaacgtcaggctttgataatatagcattaaatgataaactgtactgccgagaaagcaaagccattatgttaacagaattgtgcattactatgacttgtgtttactcctgtgctgcacacattttatcctgcctgtgaattctactctctggcctcttaaaaagattaaaagctgtaattttttcttgaatatatctcctaagtcactaattacattccctagactcttacatccttattcatgtgaccatttcttgtattttacaatgggactattgtcagcttaacaatctagctgtaatacccagggaaggccacacactctcaatgctaaatcacattaccgaatacttttttcttagaacttgttttatcgaccacttgagaaggtttaattgtaaaagtgctaaatgagaatcgaaagaatttgttcttttttcttaatttgaagttgctttgcttaaacatgtaatgatgcctgtgatatgcatggcatcaaaataatgcatagacactattcaaatctctgagtgacatgtgtcttaggtaccaatcttgttgtcaaatgttcactcccagggtatttgctgaaaggcttggatttcatttagggactcagttcctgttttcttcttctcaattggataccattcagttctaaaatctaaagatcaaacagttacccagaggagcttctccatgaacaatcactctttattccataaatgatccagatgttcccaggaaattagttattccttggatattacaagttaagtgaaagattattttctaggtattacactattggggatacattgctaataagcataataatattatttaaaatatctggaggatttaatgatctccagttcattttaaatttttatatgcaggaataatatagttcagtgatcctgaaagttgccgtattgcaacagatgttaaattgttgagattaattcaatgtcatgaaaatatgctcttagcagaaaacaattagctgccattcacttaccatctataccaggtaatagactcagtgttgacaagcaatcaaaaaggcacattcctagttgctattatgaggcttgtattcattctgtcacacctgtgatgatctctataggggtgctgagaaacatgaggacgtggtaaaatttcagaactatgtattcagaaaggctttgggaaaaacatgaaatcaatatggagactatgataaatgtagctcatatgacctctgttctgaacattttgtcagatcaaaaagtatgatatgttggccgggtgcggtggctcatgcctgtaatcccagcattttgggaggctgaggcggtcagatcatgaggtcaggagatcgagaccatcctgggtaacacggtaaaaccccatctctactaaaaatacaaaaaattagccaggcgcggtggtgggtgcctatagtcccagctactcgggagactaaagcaggagaatggcgtgaacccggcaggtggagctagcagggagccaagatggtgccactgcactccagcctgggtgacagggagagattctgtctcaaaaaaaaaaatgtgtatatatatacatatatatatatatatatatatacacacacatatatatatacgtatatatacatatatatatacatatatatacacacacatatatatatatacacacacacacatatatatatatatatatatgatatcttgatatctgtatcccatcattaaatattttggccaattcaattggttcattccgcatgggaaggatggttgaaagattgtggccaggaagaataagtcaatctgtcttttgattacatagattagccatttttttttcaaaattgttgtttcagtagtcggaatccctggtgcagctactctaagatctgttcctatatgcattattatctgcaaacattcctacattaattgacttgcccctcagtcaacttcaacatccattgctcttattattgccttttactataaatatattagtgaccattataccttgctcagtgtaacagaaattatatatgctaaagaacaaagtttttatgagcaattacttagaaacaccttagtaagtcatgttttctaaaaattaggaagataactgaattagagtgaaataattattgtctttcactctttgtaaaaatgaactgtttttcttttgtttattatgctttaagttctggagtacacctgcggaacatgcaggtttcttacataggtatacgtgtgccatggtggtttgctgcacccatcaacccatcacctacattggatatttctcctaatgctatccctcctctagccctccaccccccagcaggcccaggtgtgtgatgttcccctccctgtgtccatgtgttctcattgttcagctctcacttacaggtgagaacatgcggtgtttggttttctgttcttgtgttagtttgctgagaatgatggtttccagcttcatccatgtccctgcaaaggacacgaactcatccgtttttatgtctgcatggtattccatgtcgtatatgtgccacagtttttttttctttgagacggaatcttgctctgtcacccaggctggagtgcaatggtgctatctctgctcactacaacctctgcctcccaggttcaagtgattctcctgcatcagcctcctgagtagctgggattacaggtgtgtgccaccacgcccagctaatttttatattcttagtagagatagggtttcaccatgttggtcaggctggtcttgaactcctgacctcatgatccacctgcctcggcctcccaaagtgttgggattacaggtgtgagccaccatacccggccatgtgccacattttctttatccagtctatcattgatggtcatttgggttggttccaagtctttgctattgtgaatagtgctgcaataagcatacacctgcacgtgtctttatagtaaaatgatttataatcctttgggtatactgtttttctgattataatttaagtcacaaatattatagaaaatacagaagttataaaagtattttaaaaatcagccatcactctaaagaaaaccatcattaagatgttaacatatttcttttcattgtttttaaaaattgttgagactataatatatgaacaactgcctcactgcagttacataaaactttatagcaccgtgttttcttaggttgttattatccgactttcaacataagatgttatggctgcacagtgtcccattgtgttagtatgtggtaatttagttagcttggttttttatcttttttgctatcataatataattctatgttaaatatcttagggtaattttttaaaagttcaatttctttatgtgtaatagtttttcaggagtaggatactttgaatttgtgcattaaacatattcttgaaccaagactgaaaatgttctttccctgggtatgcacatttaaagtagatatttccttgatgttgcaaataatgtaatttatagacatatttcacatttatagaccctacactattaataatatgattcattattacaacagtagtgtatatagattccaaatccatttcaacctttaccagctttggataactggtctaattttacaggagaaaaatggtgcatttcataagcatttcttttctctgatactagtgaatttgattcatgcagttgtttgttaaacatccacctttcatatctttaaatcagttatttgttttccatcctctacattttgggcattccttcccttaataagttttgtgaattatattttttcttatccaaacattgaaaatatatggtcatcatacttttaatcaggcatcatttgttttactaaaggaaactttcttgagccttaggacagtgttaaagacttttctgtttctataggaaccatataacgtaacaatgactatcactgaatgagcgctaaggtttttacattaggcattttacatacactatctttttaagtcctcaaaacagcactacaaaataaatattgaggttgaaggacgtttaatagctacaggattttttttgttagacttgattttttaaatattcttatccagtttcataatcaggagtttttgcaatgacttaggtgaatttaaaaatgtccccaagaatagacataagttgctagaacaaaacagcttagaaatagatccacacaagtataatcaactgctctttgaaaaaggagcaaagatgttgctgcaatggagaaaaggttagtctcttcaacaaatgatattggagaacttgagtgtccatatgcaaaaaccagaacaaaagcataaaacaaaacacctagacaccaattcaaaataaattgtatacctacaggttacacgtaaaatgcaaaaccaaaaaattcctagaaaagcgtgaagcagaaaatctatgtaaatttgtgtttggtggtgatattttagatacaatactaaaagcataatctgtaacaaattgatacgttgcattttattaaaagtaaaagcttctgctctctggaagataatgttaagagaacgactagacaagctacagactggaagaaaatatttgtaaagtatgtatctgataagggattgtatgcaaaatatacaaagaaatcctacaattcaacaataaggaaacaatcaatttttttaaatgggcaaaagatctgaacagacatctcaccaatgaaagtacacagagggcaggtaagcatatgaagactctcaacatcattttattggaaaattgcaaattaaaacatttgtagcttcggccgggcatggtggctcaatcctgtaatcccagcactttgggaggccgaggcgggtggatcacctgaggtaaggagttagagaccagcctggccaacatggcaaaaccctatctctactaaaaatacaaaaaattagctgggcatggcggcggacacctgtaatcccagctacttgggaggcttaggtgggagaatcgcttgaacccaggaggcagagattacagtgagccgagatcccaccattgcactccagcctgggcaacacgagggaaactctgtctcaaaaagcaaaaacaaaaacaaacaccatttgtagcctcacagtggagaaacctcataaacattaacttagccaggtaaacaagatcataatcaatagtaatgtcatattgataacatgtactctaagccaagtccaaacatgagaaaatatcaggtaaatcccagatgatgacattctacaaaacacctgaccagtaccactcaaaattgtcaaggccatcaaaaacaaggcgtctgaaaaactgtcagccaagaagaacctgaaaagacatgtcaactaaatgtaatgttgaacactgaatggatcttggtacagaagaaagaacttaggtataaaactaagaaaatcagcgtaaagtatggactttgctaaacaatagcctattgatattattaattgtagcaaatgtaccatattaatgttaaatgctaatgataggggaaagtgggtgtggactatatgggaattctatatagtatcttcacaatttttctttaaatttaacactattctttaaaaagtttttttaaaggaggatctaatggatatggagttttagttttgtaagatgaaaagttctagacctgttttacaatgtgaaaatatgtaacactactaatttatacactgaacaaatagttaagatggtaaattttctgttttcttccacaattaaaactaaaaataaaatattttaaaagtctctaaaaaacaagtaaataaaaatatcccctattcatgtaatgtttctcttttatactgttaatgcagtgaattatgttttctgagtttttgtgtaaaaccaatcttgaatcctagcataaatccatgttttattatcctttttatacatcaatagatttttcttgtttatatttcatttaggattttttttgttcctatcttaatgaaacatagggaattttcttcttatttctcggaaggttcttgtcaaaggtttgtatcaggattattctagcctcatagaatgtattgggatgtgttcctttctttcttttttgctgtaagggttatatagaattggcattattcttcctttaaatatttggattatttttccaacgaagacatgagtttgtagttttatttctgggaagaatgttaaatgtacattaaatttcataaacatatctagaaatatttacatgttccatttctccttatgccagtttggttaagtggtactttcaagaaatatgaacatttcatctaaacgttcaaacgtattgcatggtttttatctgtttgtttaaccacttaaacctagagagctgtgtcaaaatattcaagtgaattttttttttagttctgtgtcctttttagttgatcatttgctgcttcatatattttgaggctaatcagcaacctgcgtatctgacctggattggtgattgttgttcctttatgttagctttatttatcaaaatataatgtccactttgataacacaaattttaatttttttttctggtaagcacaataatctaacattattttccatattggcctaatacacaattttttccatcgatgaatctcttggtgttttttttttaattgatcatttataaaattatttgagagtcaatttttttatgtgaatttgagtttcaggtcggtcataattgcatagtcatatttattactactagtttatttccctcaaataaaataagttccgtcatattggtcactacctattctccatcctcattccaaaacaagatttgttgaaaatctcttgtcattgttttggttaacattacaatttcaaaagttaataattttttatattcctcatatttctttgtttttaactgtagtgatttctgataaaaggcctttcaaagagggctttagttagatgacatttctgagtctgagttaactctaaaaacatacttatgtttttaaataattttgatagatacacattttaagttcaaagtgtgctttttttcctggacatgtacttcttgtttgtgactgtgaagctcttttcctcaggaagctttttgaattttcctttggctttttgtgttattgaatgtaatttgatatgttcataagtctcccctccccaccttatctttttgtttctgtatactctgaatcattttaatctaagatcttatagctctctttagttttaaaaaattattggtcattaatccttcaaatattcttctctttatatatttttccctcctggactattattaattcaatactgacatttctatatatatattctctacatctcttaccttatgtttcttctattctttttatttccttatcccttccagttgcattctgggagcgtgctttgacttaattgttcagctcactcgtttgttctttagttgaattcatttgacagttcaatccttcaattagttaattaatttaatttttaatgctttatacccaatgtttctatttgttttttctttagaaattctcatttttacttgacatttccaatattatttcttatctctacaaagataattattattcctctttaaaattttatattttcctgcatcttattttacccttatatagtttgtcttaaaaatcctgctcatcagctgtcttgaattgttgtcctatggttcattgtctctgggaggtcacagtcacttatactcctctcaatctgggaaaatgtgaaaaattcagaccttatttttttccctttttataattttaaataattaaacatttcaaaacaaaaatctaaaatatcaaaatgtagactgaaccacttctgtttgtctgcctcataccactgaccatccttcttcctcagggatcttgcttgttttttgttactatcttgtcaagtaccaccattctttctgaggaaggagagagtatattagtctgttttcacattgctataaagaactacctgagactgggtaatttagaaagaaaagaggtttaactgactgacagttctgtgtggccgaggaggcttcaggaaacttacattcgtggttaaaagcaaaggagaagcaagcacctccttcacaaggcagcagaagagagagaaccaacaaagggggtagtgagacactttgttttttttttttgagagggagtcttgctctgtcgcccaggctggagtacagtggcacaatctcagctcacttcaacctccgcctcccgggttcaagtgattctcctgcctcagcctactgagtagctggaagtacaggtgtgtgccaccacacccggctaatttttgtatttttagtagagacggggtttcaccatgttgcccaggatggtctccatctcctgaccttgtgatgcacccgcctcggcctcccaaaatgctgggattacaggtgtgagccaccgcgcctggcccagtaagacacttttaaaccatcaagtctcctgagaactcattcattattaggagaacagcatgggggaagcacctccataatccagtcacctcccagcaggtccctcccctgacccatggggattacaattcgagatgagatttggatggggacacggagccaaaccatatcagagagtattgctggaagccactagtacctattgttaaccactttctaccccagctattattagctaggctgtaagacttctcaaacttgagtgtttttcagaagtacttggctagcttattaaaacacagattgtttggcttcatcctcagagattttgattcattagggcctgagtggtgggccccaagggtttgcacttgacatggacccagatgttgcaatgctgggtctgagtctggaatcacatagagaatgttcacatttattaccccaaattctctgtcttgggttgggttagccctgctgttgttgcttctgtttggtctctctcagtgctgatgattgaaagaggcatcacttcacccagtacaatggggtctgatggggagggaggaaacaatgtgagaattcttccccagcctcaactcttagctgctagagctctttctgccatgctggcattctataatctttccaagggttttcacagttttaatttagtaactagaacccatcaaattccttgtttctctgtggcatctcctttaagatagaatccagagtagaaagccaccaacctatgttggttcatcatcttttcagaaatttgaagtctaatgtgacttaaaaaaattcttaaaaaaactgttgaataatatgattttcatatagctatatgccaattactttgataacttcttgtgtttaagattatctttcctaactagctataactatagtaatgtaatgcaagcctatcttgtctaaactcagacaatgtatttcagtgatatgttttcctttatcatctttagaagcttttttttgtcattaatgtcaaattgccaagacaactaccctatgtgggtaaaaaataatgagaccacaccttgctttttttttttttttttttttgagagggagtcttgctctgtccccagactggagtgcagtggcgcgatcttggctcactgcaagctccgcctcctgggttcatgccattctcctgcctcagcctcctgagtagctgggactacaggttcccgccaccacgccccggtaatttttttattttttttttgtatttttagtacagatgggttttcacggtgttagcaggatggtctcgatctcctgacctgtgatctgccctccttggtctctcaagattttttttttaatacaacatcttgaataccttttagattctaatagctgtacaacttagaacacctttgggttttctatcttcacagtgtacttataggaccctatcttgttatttaggttttaaagggactgtattaacagaagaaagatatgtgtctccagagcatgaatgattttgtcaaatccagaacagggtttcaaacactgaaaaatgtcagattattttcaaacactagaaaataaatgatatggaaaaacaatatatgacaatgaggcagataagtgttcatttctggtaatgagggcccctggaccacttatttggtaggttggcctaacatttacatttatgtcaattctttggactataaggaaagcatctcttatggggatgacaatagcaagatacagcgctacaatgaaatctaattgttattcactattgcactggaatgtcaatgaggggatgcattgttcaaaagctggcattggtaaagttattaaattgattggttcatgaaggaatatagtacattagtgagctactcatctgtgaccgagagtatgtattagaaagcgtgccttcataagtttccaacatcataaatcaaggcaagatttagtacacaacactggcaggaagcggcaatcatatattttacaaggctcagctcaagaaagctcaaccttcagtcatatttgggtcagtattttatatttataatttgctccatactattgtcatgtttattatatttggttcttgtacaaggaatttataatatgaatatgattagaactgagcgacaaaaagacaatccctgcagatttctattgagtttcctctatgcttggtaaataaagtgtatttttttgacttttaattatatatgtttaaaaagtgattgtaaccaattttgcattcattcccacgttgcttccataagtaattattctaagttattagatataaatctaaatattgtaaaacaccctaaagctagagtgaaaaagaaggttttttaataagaagaacagatatttttaagcagtaaaattagaattttattttcacatttatactattctagcccgaatatctgcttcttttatcaaatcttatctggtctttcttatctgaatgaatatcacttctctggattttattactttgttttaaatgttttagcactcttaactaatttcacctcatattagagttttacacatatccacttcctctacctattctgtctacctattgacaacaaaaagcatatctggttaattaaaatacttccttttctttcccctaatacacttacagtcatttacgagtttaatatatcttgtgaataaattaatatttatctgatgtcaaatataagaattcataaaacatcaaacaaatgttttggcttaacaataattattacataagtactatattttataaatagtaactaatataagtagtttacacatataatttcggtgctagaattcagtatataattttattagttaccaaactaacatattaaaatctcatattaaaatctcagaagatacttttagtgttataaaataatctaagtaattaataaatgtgtattgtgtatgataaagtttccatgcataagtttacaaatacaagtgcttatatataaattatattattaatgatatatatatgcaaataaattctggaaatacatttacataaaatgtatacacacgaaatcaaccttcttatattcaacaatgctttcccatgcaaacaaatgtaaaaacacctgtaaacattcctatattgtttctctgataaaacattaacatgttagatacagtatgatgtgttaggatgtgcagtagccacgtggattgatagttgggttctagactcagcaacaccaagagccaccactcgtcatttaggaaatagcctaacttctctggtcttttctaagctgccttgtaaaatgagtgtatgaaacttcgatctctaaaatatctatgccaaatagaaaaatctggccctaaatatagtcctaaggctaccatatttttagcagtattaagagctcctggtgtctgtctgtgtatagacattagtgtgaatacaacatgtgttggggaagggtgagatggaaaaaatacacacaagatatactctatcaggaggaggtaaaatttggccagtgtaggtctaggtacacagtagttgatgagcaaacagttaggacatgcctagagttctttaaatttgctagtcagccacagccatgtgaggaggagttgtcattaaacagagaattaaaggatagaagagccaattctgtccattagatatagcctttctggcaaatgaaacaaaaactgcaagtgtgtaaggccaaacagagcttgctattctcttttgaggctttttttttttctggatgttgttaatttgtcctatgtgtctgtaaatcattaggagagaatgtgtcagtacccagtaatccaaaaatcttttgtaaataccattaaaatattaaataatatatgctttaaaatccttcaaaagtttaaaaaaatctaattttattttacataatcaaataatagaatcagagaactgaagggcatctttataaatgtagcccagtggttttcaaattctgcgctatagaaccattaggctcagtttagcaatcccataaggcacttagttaaaattacgttaataaagtctatcttttttattatttttgaagttgtaattttaaatgggaacaacttcaaatgtcctataaaccaaagtattaattaactggataccattaatataacttctgcttcaaatctgactttttgttttctgagtctgaggactatggaatagtttttcttgctctcacatgtgtatgtgtgtgtgtgcgtgtgtgtgtgtacatgaacatgtatgtcatgtgtactaaatgattatttattaaggttgtaactcagtattgttattattctgagcgaaggtctccacgtgcctactcccattaacttataaagatgagtatcctgttacagcatgtgcatgtcatatgtaattgaattttatctaaagttaggacacatatttcttgctatgtgctataattatggtcaataatagattgttcaacaacaagaaaataaaaaatattttcttaatggtaccgtattatgaatgttctaatttttaaaactactgattatttaatgttttgtttgttatttattatactttgattcaaattttgagtttataataaatactgtgattagtgtttgaaattttgaagcaacaattgcttcaaatttttagaatcattttggtgaaaagttatgctacatataaaattgcttaaattattcacagttacttatttgcatgggtcaagacttcttggaattgttcaaccaaaacaaaatgtagaaataaaataattctgccccagaaaaaccaatgagttaaagatgagattaagaagtccttttttttttttttttttgatacagagtctcactctgtagcccaggctggagggcagtggtgctatctcggctcactgcaagctccgcctcccaggttcttgccattctcctgcctcagcctcctgagtagctgggactacaggcgcccgccaccacccccggctaactttttttgtattttttagtagagacagggtttcaccgtgttagccaggatggtcttgatctcctgacctcatgatccacccacctcggcctcccaaagtgctgggattacaggcatgagccacagcgcccggccaagaagggcattttttaaataacttaagacaaatgaaaatggaaacaccacagacaaaaacttatggcatggagcaacagcaattctaatagggaagtttttaagtaagtaaatcaaaaaagaagaaagatcccaaataaacaacctaacattacacctctaggaactggaaaaaaaagaataaaccaatcccagagtcagtagaaggaagaaaataataaagataagagcagtaataaatgaaatggagactagaaagacaaaggaaaagaacaatgaaactaagtgtttgttgtctgaaaagataaaccaagttgatatacctttagccagactaagaaaaaaatatagagagagaaaggactgaaataaataaaattataagtgagaaaggagatactacagctgaaaccacagaaatacaaatagctatgagagactactgtgaacaaatacatgccaacaaatttgattacccagaagaaatagatatatttctggaaatgtataaactacaaagatcaaatcatgaagaaatagaaaatctgaacaaacccatagcaaggaggttgaataaataataatcaaatgtccatcaaagaaaagccccgaaacaaatggctttgttacaggaatagggttccaatccagacctcaagagaggattcttggaccttgcataagaaagaattaagaaagtaaaggaataacagaatggctaatccatagacagagaagccccgagggctgctggttgcccatttttatggttatttcttgatgtatgctaaacaaagggtggattattatgcctcccctttttagaccatatagggtaacttcctgatgtggccatgcttgtgggagtgtagcagtgaggaccaccagaggtcactcttgtcaccattttggttttggccggctcctttactgcaacctgttttatcagcaaggtcttcatggcctgtattttgtgctgacctttcctatctcatcctgtgactgagaatgccttaaccgtccgataatgcagcccagtgggtttcagcctcattttacccagttctgctgaagaaggagttgctctggttcacaggcctctgacagcttcacagccgaattctaccaaacatttaaaaagaaactaatactaatcctcctcaaacacttccaaaatattgaagaagagtgaccattttcaaactaattttacaaggctagcattagcctcctatcgaaactaaataaggactctatgagaaaataatatttcaggccaataaccctgataaacataggtgcaaacgtcctcagcaaaatatagcaaaccaagtttaacagcacattgaagcaattattcaccatgatcaagtgagatttatgcttgggacggaaagatggttcaacacacaaaaatctatgaatttgatacattgtgttaatagaatgaaggactaagctatatgatcatttcaatagacacagaaaaagcatttgacaacatttaatattttatcatattaaaaaactctcaacaaattaggtatgaaaagaatgtacctcaacatgataaaggccatatatgataagcccacagctaacatcatcaaactaaatggtaaaaagttgaatgcatccctctaaaatcaggaaaagacaaggatgcccactctcaccacttttattcaacatagtactggatgtcttagctagagtaataagacaagaaaaagaacaaaaaacattcaaaaaggaaaataaagagtaaaattgtctcaatctgctgatggcatattcctatgcataaaaaaccctaaagaaaccaccacaaaaccgtcagaactagtaaattcagtaaagttgcagtatacaaaagcaacatgtaaaaatcagtaacattcctttatactaacaacaaactacctgaaaaccaaattaagaaatctatcccatttacagtagaataaagaataaatttaaaaaaaaaacatgtaggagtaaatttaactgaagtgaaaaatatgtgtattgaaacttttaaaacattgatgaaaaacattgaagaagagacaaataaatggaaagatatcccatgttcatggattgaaaaagtttatatattttaaatatccatcctacccaaagtgatctacacattcaatgcagtctgtatgaaaatcaaaatgtcatttttcatggaaagaaaaaagtgtcctaaaatttatttgaaaccataaaagaccccaaatggtaaaagcaattgtaagcaaaaagaagaatcctggaggtatcatgctacctgactttaatacctattgcaaatttatagtaattgaaacagaataatactggcataaaaacagacacattgacaaatggaacagtatggagagcccagaaattaacctgtgcatttatggtctattgatttttggcaaagataacaagaatatgcaatggagaaaagacagtctcttcaataactggtgtttggaaagctggagatgaaaatgaagttagacccttttctcacaccatataaaaaatatcaactcaaaatgaactaaagacttacatgtaagacctaaaactctaaaactattcaaaaaaaaaaaaaaagagaaaactgcatgatattgatctgagcaaaggtttcttggatattagcaaaaaaacacaggcaacaaaataaacaaataagaatacgtgaaaataaaaagcttctgcatggcaaaggaaataatagagtgaaaaaacaacccaggaattgggagaaaatatttgcaaaccacacatctaataaggggctaatatcctaaatatttaaggagctcaaacaactcaataacaagaaaataaataacccattgaaaaatgggcaagggatctgaacagacattttccaagagaagacatatatattttgtaatatatattttgtaatatattttgtaatatattacaaaattctcaacatctctaattagcagggaaatgcaaatcaaaaccgcaatgagatatcacctcacatctgttagaatggctattatcaaagtgacaacagataagtgttgaagaggaaatggaagaaggggaaactttgttgttggtggaaatgtaaactaatacaatcattatttaaaactctatggaagttcctcaataaactaaaaatagagccaccatatgatccagccatttcacctctggatatagttccaaaggaatggaaatcagtatgttgaagaaatgcctacacttaagtgttcattggtgccttgttcacaatagtcaagatgtggaacagacctaagtgtacatcgaagaatgaatggataaagaaaatgtagtgtacatatatcaattaaaaatgtagtgtacatatatccttaaaaaagaaggaaattctgctatttgcatcaatgcagatgaacctggagaagattatattatgtgaaataagcctggcacaggaagacaaatatcacataatgtcccttacatatgcaatctaaaatgtcaaactcatacaggtagagagaatggtggttaccaaagaccggagaaggattgggaaaggggagatgtagatcaaagggtatgttaaaagaaaaacttcagccgaattaaatttaatggggtttaattgagcaatgaacagtttgcaagctgggcagcccccagaatcacagcagattcagagagactccaggggtgcctcatggtcagaacaaatttatagacaaaaaaaagagacatgacctacagaaatcagaagtgaggcacagaaacagctggattggttacagattagtgtttgccttatttgaacacagtttgaacactcagcagtgtatgagtggttgaagtatggctgatgggattggccaagacgcagtattgttacaggaacatactcttgagttaggttttcaatcttgtctacctattaagttaggtcatggttcagccacaaggactcaaatatagacgtaccgagtccttctcaggccatatttagctcactttaacgggtacaaagtttcagctgggcaggaggactgctttttagtgatctactgcacagaatggtgaatagaattaatgcattgcatcttttaaaattgcttaaagattagattttaaacgttttcaccaaaaaagttgataagcatgtgaggtgatggatatgttaattagcttgatttaatcattctataatgtaagcatatattgacacatcatattgtacccccaaaatatttacaattattatttgtaaatttaaaaaattaaattgttttgatggtatattattgatggtgtcatacattacttttgactttaaatattggtatattagaatagcctcactgtttaattgaatgtttttataataagccagtataatagatttgatattatgagatgaatttgaagttatacatgatttttctgttttacaaatttgtgttatatacaaggtaggctttttacattttccagggttaaaaaaagggggtaactcattgatgtagatcactctattatttctcccaagcttgttagaggtacagcaaatgattttcagatggagaatgagattctctcagacttttacaagctagttgttttgattggttgtttgtttgtttggtggtttttttggtttgtttttgtttttgtttttctctgagatggagtcttgctctgtcacccgggctggagtacagtggcccgatctcagctcactgcaacctccacctcccggttcaagcaattctcctgcctctaaaacacagttttattgtgataaatttacattttatgtaatgaccaatttaaagtgtacaattcactagttttaagtatattcacaatcactagtctgtctgagtccatagatttgcctattctagacatttcctctgagtagaatcttacagtatgtggccttttgtgtctggtttctttcagttagcatatatttccaggttcatccatgtagcatgtgtcaatactctggtctttttgttttcaaagaatatttcatggtaaggatatcacacattttgtttactcattcatcagctgatgaacattttgagttgtttcttctttttgcctattatgaataataacactgtaaacatttatgtataaattgtatttgaacataggatttcatttcttttaaatatatacctaggagtggaatcactgggtttaagagtgactctattgtttaacatgttaaggaaccgccaaactgttttttaaactggataccacactgccaacagcaatggatgagcattccatgttctccacattttcatcagcacttgctattctctctctttttcaatgtaactgttctgtgggatatgcagttgaatgctattatggttttggttcgcagttttctaattactagtaatgtcaaatagcttttcatgtgcttattggccattcatttatctttgttgtagaaacatccattcagatcctttgcctagtttttaattgggctatttatttttttattatcaagttgtgagacaccagcagtgtttgaggattctacaaactagtttaaacctgtggtcatcattcttgcataacatacataactccatttttaattaggaaaaaaaattaaccaggtttctgtagctaagcaatgttcatcttatatgtgaatacccagtcagataatataacttactgatactactatttgaagatttaaaaatacataatttcatctcctaccaaacccatttgctagctgatattttagtgcctttccaaaggcatgacaattattttcctatgaactttcattttgaagaaggaagttgaaaacaaagagatgttactatggctctcattaccaaagtctacttccaaaagaaaatgatagaggaatatgaatttagaaaatatctcctatgtctctggttgtacagagtgtatgtgcgtatatatatatatatatatacttttgttggatggaatatgaccagtgatctgtggaaataactgctggaaaaccaaaaaattgggatactatttgcaaagttaatatttttacacctgttaattttactcatttaagaaagtataaataattttatcatgcgttcatttccggtgcctggaacatgaaaaaactaaaatataattttaagtttttcgcttactcaggtaaaacctcattatctaacctcaagaccactgaaatgaaaatccagttgtaatcataataacactcgcacagtggtgataggttatatccatacagtttctgctccagtgaaattccattttaagaaaatactctatgctattcagtcgctggacattcattgtaataagatgtcatttgtataagcaatatgaattgcattcttctgtcaagtggacataagttcaagtatgggtgactttgagaaagattctatacatggtagctgaccaatttgttttggtggctatatagcttaaatataacaatggttgatattctatgaaaaatagacaacaaaaaaatctaattgtcattgtttaaatttaaacagataatgtcaaaactccagaaaatatgtgacatctgctaagtaataattctctacatctctatacgcctttttttttttttttttttttttttttttttttttttggcagagtttcgcttttgttgcccaggctggagtgcaatggcgtgatctcagctcaccgcaacctccacctcccgggttcaagcagcaattcttttgcctcagcctcccaggtagctgggattacaggcatgcaccaccatgctcagctaattttgtatttttagtagagacgaggtttctccatgttggtcaggctggtctcgaactcccgacctcaggtgatctgcccacctcggcctctcaaagtgctgagattaaaggcatgagccactgcgcctggccctgtatgtgcttttttataacattatcttatgaaatgtaattggagcattcatcacattgtaattgtacctttgtgtgtgtttgtgtttgaatgcgtgtgtgtgtgtgtgtgtgtgtgcgcgcgcacatttcagagaaacctgagaaataattgtatggaaataattaaaggtatcttatgaaatgtaattggaacttttatcacattgtgattgtacctttgtgtttgtgtttgagagtgtttgtgtgtgtatgtgtgcatttcagagaaatctgagaaataactaagggtatggaatgtatgctttatcttcattttgccagtacctagtacaatgtctgacatataaaagtactcaggaggccgaggtgggcggatcacctgaggtcaggagttcgagaccagtctggccaacatggtgaaaccctgtctggactaaaaatacaaaaattagccgggcatgatggcgagcacctgtaatcccagctactagggaggctgaggcaggagaattgtttgaacccgggaagcaaaggttgccgttagctgagagcacgccactgaactccagcctgggcaacagagttagactccatctcaaaaaataataataataaaaaataaaaggtactcagttccaattcattaattaattactatagttgctgctgttagattggctgctactgctgctgctacaaatactatctctgctattgctcactattatttattgagggctcattatgtgctatactctttttacttcttctcacttcatcatcgtaagtatgtggtactcttgtattgctttatcactgaaaaaaatagggtcacacaaaaaaataaagctggggagaggttaaaattattttatcaaggtgagtattttggtctgctttgtttttttacatttgtttccttgtgtgttttgcatatataatttcctcagaaaatgtgacggtaaaagaaactaggatccaacatatgtttccaaataggtcatagtgaatgggatcagacatgtgaaaattcattcaatctctcatgggcatcgggcaagggaaagggacatggggttgtacatgtgatatctttagttcaaccacctaggaggaaaaagtgtgctttttttcttgttttatttgcctctctgccacaaacccatgtttcaaagcttgttcaaaatgaatactcaataaatattattgataggcagcctacctgccacacatcatctttgataagtgaattataatgacaatactttgggttacgatgtctgccctttgagagaaagagaatttaaagtaaccacggcctatctcagcttgctggagatataaatctcttggcacctattagcataatctacttatggaagagacataaatgtggagcgaaagggttgcaaaatgatttgttgggtactattgttgagccctaatttaaatcacttggttttctccattattattccaaagcctcatctgaatccttctgacattgaatgtactttataggaacagtatattcctataacttgtaaaatctttaatgtaagatttatattatcttcagtaagatggatgagaataattactttaagtcttgttaagttcctcaaccaatgctgttacaaatttgtacaacagaaagaattaaaatgtcacaagatatatttctgagcataacaatcacagcatttaaaaatattcttaagcatagtatttttaaacaaaattcatggattatctttgcatatacttatacacgaggacagtatggttttcttgaaaacattagttacaaccagctttcaggttcatttttaagtatgggccatattgctgtatgtgaaagctgacgtttcaccagagccacagggacgttaaagtttaaaacagcaaatgtaaaatcatgccactggtcatttgataaacttgaaaagagaggacacaaatgtcagtatctgtcaaagtaaacacaattcatttttttattcatagcagggaaagtcatatgtcaaaggaaaaaaagcgtaatttgctgtgagaagaatgccaaggaaaaggacaaaataacatcgattcggtagttagactgaatatacaagaagtaaggaaaaatgtgtattaacacatatatatcagagatgtaaaatttatatgaggtaccaaaacatcatgttatagattcccttctctacataaccaggctgatgctctgtgccaatgtaaataggcccaattattaccgtttctagtgcagcagaaagcaaagagattcacagaaaatactgccttaggctgtcaccatggtggtctcagcaggggctgagctaagcttgagtctacaggactgacccaaggcttgaagaaaccaatgagggtaagacttcacacagagggtcgtgtcgcaagggatttgctaaagatcaaatcctggtgaccaagaaaagcccaatagctagataagaagtgaagtctttgaagcacacctagcagaacagaactagaagaggagttttccaaggtaaaactctgcaaatattctttgaagcaaagatacagagaagatgaaagattttataaaagcatttttggctccttccatggggatagaaggagttctttatggttgaagaagtaagtaggagacaggactaataatactaagaacccacccatagacctttcactaagttactcgatttccattgccttcaagtaatatatttgattgccttatttgtaaatgtgatagctaacttgtcttccttacagaacacctgtgaagattaaatgtgactatgaacataaaagcactctacaaaattaaaatgtatttacaaatggggaattattattctgttaattttcttttattttccttcctttcttcttttcttacattcaacaaatatttcatgagcatctagcatgtaccagacattcaatgccctaagtgaacagtcaaatcttcttcctctagggagctcacattcaaactggagaaacgtaaaacgaaatgctgcagtagatgggactagtgctacagaggacagtaaataagaaaaaaagaactggagcaatgataagaagtgtgggggtattgaaattttgacagagtatccatggaagtcttccccgagaaagtgacattttatgcaagactaggagacatgaaagaatgaatcatgcagatttctaggagaagactatccaagcagagggaagagcaatcgcaaaggccatgaggtggaagaatgttaacatatctcagaatctccaaggggagctatatggttggagcagatagagggaagtaagtaggatatcagtttagaaaggcaatggagcagcagatcacatggaacctttagggtcatggtgaaggttttggcttttcctctcagtgtgggagaaacaggacatagctaggcaactcagtttgttacattgagaatagacagaagagaaccgatggttaaaactgggctcctgttaagaaatatactgaaagaattcagttgtgaaatgatttaatgtggaaaagagtggtagcagtggaactgttgagaaatgttaagatttttggatataagaataaggtagactcaacaggttagctggagtcttgggtgaaggttgttaacaaagagactaagtagtctgagcaaacagggggctagagttgacattaactgagatgggaaaactggagagaagaaattctagggaggaggaagtggtaagagttcagtttgggactttctttctttctttctttcttttttttggacggatttttgctctcgttgcccaggctgtagtacaatgcatgatctcggctcactgcaacctctgcctcccgggttcaagtgattctcctgcctccgcctcctgagtagctgggattacaggcgtgtgccaccatgcctggctgattttggtattattagtagggacggggtttcaccatgttggccaggatggtctcaaactcctgacctcaggtgatccacccaccttggcctcccaaagagctggattacaagcctgatccaccgtgcctggccagtttgggacattttaacttagtagaggcatattaaacatccaagtggagatatcaaggagacttttgatataaatctgaagattaggagagtagatttggttgaattcataaatgtaggcattgttagagtagaggtgaggtggtctgtaaatctaggtgattggttaagaccttcaagggagtaagtatggacagagtagagatctacaaattacctgagaggcatacctatgtttccacgtcagaaagataaagaggaggccgggcgcggtggctcacgcctgtaatcccagcactttgggaggccgaggtgggcggatcacgaggtcaggagatcgagaccacggtgaaaccctgtctctactgaaaatacaaaaaattagccggggacaatggcgagcacctgtagtcccagctactcaggaggctgaggcaggagaatggcatgaacccgggaggcagggcttgcggtgagccgagatcgccccactgcactccagcttgggcgcagagcgagactccttctcaaaaaaaaaaaaaaaaaaaaaaagaaaaaaaaagaaaaagaaagataaagaggaacaagcaaagaaaaccaacatgggacaatcaaataattaggacagttaggacagtgtggtaatttgaaaaccagatacagaagatatcccggggacagggagcaatgcactgtcaaatgcttatgattcagttgtatgattcactgcaacctccacctcctgggtagatggttgaatgaggatgaccacttaccacctgctatggtttggtttgttcttgcccaaactcacgttaaaatttgatcccaaatgtggcagtcttgggaggtggggcctagagggaggtgtttcagtcatgggggcagatcctttatgaggacagagtaatgccctcctgcagggttacttttttgcactccagtgaaggggttagttcctgagagtagcttgtttcaaagactctggcttcctcagtttctccctcttgtttcctctctcaccatgtaatctctgcacacacctgctccccttcctctttctccaatatgttgaagcatctggaggccctcaccagatgcaacaggctgatcttgaactttccatccattagattcatgaaccaaataaacatcttttcttcacagacagcccagtctcaggtattctgttacagcaacacacatggactaagacagcaccacacacaacaatgcaaaagccatttatgatcttgaccagaggaatttcacctcaaaggtggaggcaaaatcatgataaagttagtttaagaatacaagagaaggctgggtgcagtggctcatgcctgtaatcccagcactttgggaggccatggcaggtgggtcacttgaggtcaggagtttgataccagcctgatcaacatggtgaaaccctgcctctacttaaaatacaaaaattagctgggtgtagtggctcatgcctgtaatcccagctacttgggaggctgaggcaggagaatcgcttgaactcgggaggcggaggttgcagtgatccatgaccacaccattgtacaccagtctgggcaaccacagcaaaactcggtcccaaaaaaacaaaacaaacaaacaaaaaaagagacaagagagaaagtggagacagcagggtcagtaatattttcaatgagttttgctaccaagagaagcaaaattaataataataataggggatataaagttgagccaacattcttattttaataaaaaaaatcttccattaggcagcattcagaacagaggaaaacaattgataattattggaacagtgctatggagcaagtgagaaggcatggatctggtgtccaagtgagttgtcctgagatatgtttgggaactctgctctgtggaagcaggaaggccagcagagtttgtggacacagatggatttttgggtgaatgtggtgcagagagcccgcagaggctttcttctgagtggtctggattctcagtgaaatttgaagctaagaggaagactggcatagagggttgggcttaggcagaagtggtatatcaagataagtgcatggaattggggaatgggggacaaggcagggaaagtatatgtgaggaaattactatgaatgatcatgtaagcaaggtaaaaaggaaaatgagaaatgaatggtgcagggtgaaagtgaagaatagtgaaaggctggaaggtttataaatcccagggaggtatgttttcaaagctgcttattggtcgtgagacccaaaagtcttggtcattccgtctgctaaaaagtcttcagtttctttgtatccttatcgcctctgccttatttaacattatcattatcattatcattatcattattattattcccagggcattttccttgcctcttctagagtgctaaccaaaatatcacagaacagcatcatgagcatcacttgggggcttattagaaatgcaaattctcaggcctcgacttaggcttatcgaataaaaatctctaggactggggctcaggtgattcttctgcatatcaagtgtaaaaatctctgctcttactgcatataacatacaaaaatctctgtccatacagccacccaagggattttccacataagcaaacctcattatgttctacttttcctcaaaaaaatttgagcctgctttacctaaagcataacatctaaaaatgtgtgcttagctcattcccatatttacacctgtgctctcgtcttgttgataatatcttcatgtcttagcctctgctgttgttggctctgaaaggtattccttatcttgctatacaggcagaaaaaaatttattcagttttcacatttaagctgagacctgttctcattcctcttggtcagctcagatgcttttaccctatgctttcaccaaactttatatagacttcaattttaataggcatatcattatattattaatttttacatgtattgccctccactaaacagaaagctccttgatggtaagtatatttttcttttatctttgatgtccagcatctcaatcagttattaggcagtcactatatgttcttggaagatgaataagatattccaaagtaaagtggtttctgcatttagatgctctgccatgtctgaatgtgacttacaataatttattatatgttatacacatccagaaataatgaacaatctgtttataaagtctatttccttacaccaggtcatttatgaatatgttaaataacaagatacttataatactttcatttttcatatggtaaagccaaacgtttactaatttttcagcaagactttgtgatttgagtgaattatttttcttgaactataaaggatttttccaaccattcagattctttccccagagtacccttgcagtacctgacaatatttgcctattactttgtcaaggcaatgtgagtgtttctgtggttttgcaacaaggtttgccaatttgaacaatgattgaagtcatgataatgacctcatcaatttcacattctagactgagccaaccaattccgttcagatttgttatgcatttcatttcatggggccatactaagcaaacactttcctgttaatctttgacaggtgggccaactgacacatttaaacaaatgaagtctttttatttattgttggtagattaatagaatcatctgataggtaaaaccccaaaaattttggtgtagtttcaacacttctggctgatgtcatatacttgtcacacaataatgcagactcatattactcttgaattattacagtaaatgtgtgacgtggtataaaaaacagaactacataatactctaaagtattaaaggcatatgaaattttggggaagactacttgttttggaagagcattactaagtttacaaaggaatttacatagcttcctttagtattttgacaatataaggtcattgtttaaattttgtttttctaaattatacagagattatatcaggaaatatatatatgtgtgtttgtgtatggtgtgtattcacacacactcatacacactaaattaaaggaatgagtcaagaattcttttacaaaattataaaccccttggattgatacttccaaggataatctgcttgacttcttgaaattcttgacatctgtattctgtcttccttggcacatgctagactgccctttccagcattcctgtagctatgtgtgatgatgtgactgagttctggtgaatgcaatgtgaatggaaatgatatgtggttcttccaggcaagaaccaaccaaccaaacaaacaaacgaaaaaaacactagccgacttttcctgtcattgggctgaatgaacaagagtccagggatctaaaggatgcacctggctccaaactgtttcaatagagaagaaagccccccacctccagtccccactaaccctcattaaattacgatctaatcaagatatttgcattgttttaaaccactcggattttaggattcatctgttatagatgctattattatttgccttaattatcatcactggaatctactctcaatagccaacagtcagtcttatcccaccctttatcctaccctaggtatggttgaatgtctaggttctgcttggcaaagatgatttagacaataaaggagaaaaactggaaacttggacagcgatcaaggcagaggatggccaagcttagcctggagcatgcacaagttttcaacataattgcaggcttagttatggccttaggatgaaataagtggaaagctaaaatggagaaataaattaagacaaaaatctagatatgacttaggtaaaggtgaagtctgtgacaatgatgagaacttgctccagaggttttatagcacataggtttactggtcaaagcgatattttagcagctctgattctatgtagctgattcatattttaaaagccccaccttataagagtaaaaactattttctgtattggtagtatttttatttatcgaactcttccaatatgtatttgatgaaaatgataggttgtttgccacattgaggagaaatagggacacatcatatgcaggccagatagtggctaatctcctaataattatcagattgtctctggacaagggatcaagtttatctgaactttacctacaaccatgccagctaagcagaactactcatggattttcagttttttcatttaaatttgtatattaatatgtgatcctaagtaatgatgtatctaaagcatctttgtttactttacactaaataaattaggatttaacaatacagttgtacaatttgtttttttgtccaaccccaagattattgatctccaggaactgaatccccaatgctcaagtgattcaacactttaagacaggcaagtaatggatgactgagttaaacacaaggtagagagcacatggaatatgcatctaactggtttaattaagttagttccatctaactaacttccagactaggaagctgaggagcagcaacaagaaggctctgtttagagggtcattagtaaggaatagacaactcaattaggtaatccagggagatacattttgtaacatgtgttttataaacataactcagctcaatacatacccgattgaaataaaagagtaaaatgtgagcacctcttgtgtgtcagttgtgacgcctcatgttttactagtgttatcacatttagagcttagggcggtcttgcaaaattgacaagcaatttgagagataagaaaactaattcaaattttgaggtcacatttggatactatgatttatggcttgctagtcactttcacaaagtgattttttacagccataatttaactttctatttttttaaatcgatttacctcttgtcttggcaaataggtaaactggattataattacatggtaccatcataggttccccagaaaagggtttttttaatcctctcaaaatcaccaccacttgctcacttatattttgaatctgttttagaaaacataaaactttctttctattattagagctctagctttatatgtaaaaacacctttggaagaactggcacattaaaattgtttcacacagagatgtaaatgggtgccaatcttcattaagtttgctgtgacataaacaaaattatactttttctatatcatgactaaaaagtaaaagagcgaaagtagactaacaaaatggagagaaagatgccataagatttcgcaagaaacacaggaaaaggggggcaagggatattaaaccaaaatatgagattaattcccactttttctaaggcacaacttcagatgtttaatttttcattactaaagaagataacgatcaacctttaaaaataattgtttttccatattatctttatatctgttttttatagtgagacattcatgttttgttcattcacttccatgatgcacaccttgcactgataaaatgaccaaggcacccccaggactcatcatggatggtgacgaaaatcaagcctgaaaacttggattcagtgtgtcatcctttatagtagcacaatttagaaacaagttagactattatgaataagttgtttctccacagattattttctgttttgttaaaaccccatttagaatgagattgattgaatggtaatcacaactattctagttgccaatcactctttgggcttcactttttgttattgtcctagagggtcagcagctgtgaacttgttctcattaattttcctgacaagcgctagtttacatagaaatggttgagtccaaactcaggaccaatttgaattcatttgaagttagggaaacaactgattagggcagacctctaaattcaacagatgttacattcagttttgcaaactgatggagattgaagatccgtggcctcagtggtttataattgcactctagcacacaattgattattgtatattatttgtcatttatatggtatgaaagcctggagcctttgactcatagatgaatgtgtcagtgaagatgctttaggtatcctactcaacccacccttatacacaaaaagacttatttacctagcaggaatctagaaacagggtggatctcaggatgatggatccattgattccatgccattgaggactgcaacacatatttccccacagtgccagtttcatcctgtattgactctcatggtgaagaatggttactatcagcaattggacctacatgtttctttgtatatatctaaaagctgagaaagaaggtttctcttcagtattctaatcaagaaagtgttctatgatttagcttgattggattgtctaagtcacatgtcaatagttaatagtgactgcgactggggaaatataatgtgctggttatattgcactaatgcacataagctccataacagaagaatagacgcattgcagttcttttggaaggacgaaggggtcaatatttgctaatcacacaaccaaaaatatcaacgatagcctctgtccagcatccagaacacagtcaggctttgttcttcatttcatttttgcattgcattttgtaattttgtttatttatttttatttttgcagttaatgaatagtaatatagtcatataccatgtaatcatgttttggtcaacaacaaatttcatgtatgacagtggttgcataagattataatggaactgaagaattcctattgcctagtgacatcacagctgtcttaatgtcatagcacaatgaatttctcgtgtgagtgatgatgatgctgtaaacgatcctgctgtgctgccagtcatataaaagtataccacatgcaattatatatagaacataatccttgataataatgttactcgtttatatatttaccatactagatttcttatggctattttagtgtgtactcctacttattaaaaaaaagttaactgtaggccgggcacggtggttcacgcctgtgatcccagcactttgggaggacgaggcgggtggatcacgaggtcaggagatcgagaccatcctggctaacacggtgaaaccccgtctctactaaaaatacaaaaaaattagccgggcgtggtggcgggtgcctgtagtcccagctactcgggagactgagacaggagaatggcatgaacccgggaggtggagcttgcagtgagccgagatcgagccactgcactccagcctgggcaacggagtgagactccgtctcaaaaaaaaaaaaaaaaaaaaaagttaactgtaaaacagcctcaggcaggtctcttaggaggtatttcagcaggtattgttatcataggagatgacagctccatgcacgttactgctgctgaagactttccagtgggacaagatgtggcagcagaagaccgtgatgttgatgatcctgaccctacggaggcctaggctaatgtgtgtgtttttgtcttaatttttaacaaaagctttaaaaagaaaaaaactaaaataaataaacttaaacatagaaaaaagcttagagaataaggatatgattaaataagatatttttgtacagctgtgccatgtgttttaaattaagtgttattacagaagaatcagaaagttaaaaaatttagtttataaagtaaaaaactgcagtaagctaaggtaaatttactaccgaaatttttaaaaatgaatttaataaagcctaggtgtgcagtgtttgtaaagcttacagcagtgaacagtaatgtcctaggccctctcgttcactcacaacttactaagtcctgcaagctccattcatgataagtgcaccattgtttgccttttacagtacttttagtgtactttttctatgtttaggtatgtttagatacacaaataccattgtgttacaattgcctgcattattcagtagagtaacatgctgttcaggtttgtagcctaggggcaataggttattccatgtagtcttgggatataggctaaatcctttttatccttttttttttttttttttgaagcagagtctcactctgtcacccaggctggagtgcagtggcaagatttctgcacactgcaacctccccttactgggttcaagcgattttcctgcctcagcctcccgagtagctgggattagccaccatgcccagctaaattttgtatttttagtagagatggggtttccctatgttggccagggtgatcttgaactcctgccctcaagtggtccacccccttagcctccaaagtgctgggattacaggcgtgagccactgcacccagccgggatataagctagatcctatatagaaggtagtggtctatacaccttcaaggtttgtgtaagtaggccctatgatgtttgcaggaaaacaaaaatcacctaacaaggtatttctcagaatgtgttctcctcattaagtgatgcataactgtaaaatgatagtaagaaatatacatatataataatatataaaaaatctgtcgtatccataaaaattaaatggaatgttttgagaggcttgacacaattaagtggttaaaaactcttgtagaattcatgttaaagaaaaaaatataaaactgacaggtgagatagaaaaatatctagaaggatttgcttttttttttttttgagatggaggttcgctcttgttgccccagctagagtgcaatggcgcgatctcagctcactgcagcctccatctcagcctcctgggttcaagcgattctcctgcctcagccacccaagtagctggggcgacaggcgcatgccaccacgcccagctaatttttgtatttttagtagagatggggtttcatcatgttggccaaggtggtctcaatctcttgacctcatgatccactcaccttggcctcccaaagtgctgggattacaggcgtgagccaccgtgcctggctgaaggatttgcaatcacattattttgcaaacattttaaatgttttaatgttttactcttcttttaaaaaaatgaaattagagaccatagaaaatatattgtggcatgattatactgaaaggaaaaatttgaacttcaactaggggctatgcactcaaagaagaaacatttctcctgcatcaaataactagtgaatggtgtctagtaaaaatgcgtttgtgctaatacaaaaatgttaagatgtgcttattatttctatcttaacttagcatttttaaaatcagtgaacaattgctttatttatttattcatttatttatttatttgtgatggagtctcactctgtcacacaggctggagtgcagtggtgcaatctcagtgcgctgcaacttcgacctcctgggttcaagcaattctcctgcctcagcctcctgtgtagctgggattataggcatacaccaccacgaccagctaatttttgtatttttagtagagatggggtttcaccatgttggccaggctggtctcaaactcctgacctcaagtggtccacccaccttggcctcccaaaatactgggattacagatgtgagccactgtacccagccaatcaattgctttaaataagaggacatttaattttaagttagaagtttaaaataaatttaaaataaaccaaataagttttacttgatttaatgaaagtgaaataatttgaagtagaattctgaactttgcataaatgtttattatatgaattttttaaatgctcaacaatgtttacaaattaaaaatcattaaaatgttgtaatcaatttaaactacatatttcatttttacagcattagttgattctttgctgtgaaatacatgattagaacttttttcccctccctaattttttcttctaccttccctctgattttgttgctttattcagcatttatataccattctatagctataatttttctattattttgtctgttatatttaaatagattcaatgcatactgcaacttctaccatggtatctccatttcgtagttattttaatgtatttcttggctgaatttatcattgggcaggtaattttttcccaagaaaaatgtgagtgcaatattcctcgaaggcttttcttgttcacatttgaaaatgtctgcctgttgcctttttcctcaaatgataatgtaactggaaataacacagaattgttgaatcatactttcctttttaaactgtggatagttttacattgttttctagcatagaatatttcagtggagaagtttgaaaacagcatactttttcccccttgtaagtaacttctctgcaaaaaagtatttcttcatccttgaagttcaataaaagatgaattaggatggatatgcatgctggtggttcagtgataaattctcctagtattttatttattgtgcctatttagtttgcaggttcaatgatctctcatttcaggagttttttcctatgttactttcctcattactattttccattccatttgttggattttctacttggagagcatcaattatctttaccttcaatcttctttgtccatcttccatatctatcatcttctaattgctttgttctctcggtctttttcttcacattcactctgattaattccatctatgccagcagcttgatagtcaagaatcctactttgtttattttggctttcattcatttattatattaatatctgtagcaaaattgttttgatattcagtttgctttgataatttttattctgctacttattaacatttttctcttttattgaattcatgtttatattaaatatgtttacatcttgtgcaattgtctctgttgttttatattttgtgtgttgtgatcctctcaacacacaccctacccttgaccaaacacgcttgcaaagttatatgccatttttaaaatctcattcatcattaatttgggcagctctgtctacaccttctatttactttgttataatgtaagtgaatgaattcttcacactttcaccatcttatctagtacctttgcttttcctttgaaattattatttgaacggtggatactaaaaataatctacttttttatacctgaagtcatgaagacagctttatcttggataaagctgagaccattccttgttggagcacatagctccattctcttcttcgaaactgaatgttttgtactagagccagctctcctagacaggtaggggttctgcaagtcagcaacctcccacacctgtcccccacctcaagaaagcaatcactctgagtttttctacctctgccaaagtcctacattgctgtgtaaaatcctccaatctcaagagctattttcattctaaaaattttccctggtttacttctagtattcttaatatatttctctccaaactggagaaatattattaaggttatcagctaactcctcttctttcctcgatactgttgtacccaattccagaattttcttttttcttttttttttttgattgccactttttgatgtttatatttatttgctgatggtgaatcttatcaaattttttaactggttttgtgcttttttggtttgcaaatttgggagggagattttgcaatactgcctccctctgacatcttaatgcaaaatcatctgatctctaaaattctaccagacatgacaaaaatgaagtaaaagaaaagaagtacaagtgagtgagggtattagcagtttttcagtaattaaaagtagcatgatgaatttagcagtttggatcgctgtcctgacattggcaacgttaatcagtaaagtttctacgatgacggaaatgttctatatatttcctgtccaatatggttaccactagccaaatatggctattgagcacttgaagtgtgactggtgtgagtgaagaaccaatatattctattatattttaagtaatttgaattaaaataaaagaattcagtaggtctcattcagtaggtcggggaaatgaccaatgacctgatactgcctatccagggtaccacactttgaaaagctctcctctatataaccaacgtttctgtacagattaaaatcacactgttgataaaattgtgcaatcacagggaaagtagtagttggtgcaatatacttgtctataacaacatagggattctcaagaatctcaggacataatctccagtaacagacaagacactactctttgttctttcctcacagaaaataaccaccttgtctctttcccattcctttcaattgttacctggtgtcttgtgataataatagaatcacaaacttccaagtcctggtttcagctgtagaagaccctttaaataggagttgggttcattcccaaataaaaaatgacactaatattttaatataggtatatatccaaatgatttcttcatgacattggtagataattttataactcactaaaggcaaatactttaatgaagaggaatgttttatgtcatgcatgcttgttaccatcaacaatataagaattatagttatttccttctgtaattcctatccctaacacactgttgacattttccatgctggaccgtataattcagtatggctcctctcacacaaattaggacattttgtcatgttcaaatacagagaaagacatagcctagcatttcctagagaagaaaaattgtcagcattttcttccactgagcaatctcaccatatagtttcattgatctaacagctgatcatattttctaaatcagttgaattttggaaccattttcagtagtgttttacagagacattttctctagcttgaatatttaaaatggtaaatattgttatctgactttattaaaaatgttaatcaggctcattggggaaagagaatcaagataatcagaacagctattctattttttaaaaaaatttaattaaaataaatttaaaaattcttctaaaatcttaaaatttttaaaattatatgacagatcccatcagttctttccatcagttttgatgtttcctatcattttgttactgttttaacaaatatgtaataaaaatcatgatgtttattattattgtttgagtctattgtttggtaggctttctctattcttgctatagatttgtactcagttatcttaaatttttgtcactagttgagtgaagatatttgatatttagtgggaattactaaacaatctgtcacgtttgataatgtgtaaatatgttggacatataatcttatattttgaaaacttgttattgcaaaagctatactttaatcttgaaagcaaatcaccaagtgagatttactcagggttcattttacatttttgtagcattcatggatgaactactttgaagattaaattataagcaataaaaattaatttactacaatagtaaatataccagtaaattagtaggaaataatcacttaaaacttatacaatacaattttaattatgtagagtccatgtttagatatattttctttatgatatacatgggccacaatcaagcatattaattttctgcctgctggcgcaaaagtcggttggtatcttcctaagaaaattttgtcagtttctatagtcttttgcaatcgtgtatattctaagacttgtttggttttgagtgttaagtctctattaatcaagtataatgaggataatctctcttacattattttaaacaagtaattttatttccctaccttccatcatttttctttgttttagctttatcaatgtataactgacaaataaaacttgtttacaagcaggatgtacaacataatgttttgatatgtatatacattgtgaaatgtctattatttttcttgattcctcaatcagacagcctatatgtgaggacagtgatgtgaatataatttgtgactgtgtgtgttttacctctttatccctgctaagaaaatagataaggaagttaagtggaaagagtatctttatatgagtaactatgaatctgatcttatttatcttttaataataatatagtcacaaatcttctgttctctaacactatctataaatgcctattgacacttttttaatatccctgtaaaattacgttgacactcaagaatatggttaagaggcatttctctactgagttacaaagattttataaacaaatttaaagggcaagcgatacattaggaaaaattatctgttacctatatgatgtacgaaaaagaaaaagtcacacttcatacagtttctagaacttagaaggaacaaaaagaatctactgaaaaaaaaaaaaaaagaatacaattcagaaattccctgaactagaaatccaaatggccaaaacacaatcccaggttcaattaacaaatccaactcttaacaataatgatacctcccagagcgctgcaggtataagcatgagccactgcaccccacctccacctttcctttttaactatcagtttcatatgcctgatttttttttacaataagcatgttatatttgtaatttttcgtttaacttaacgtcaataacgttttatactccatagtatagaaaaatatagtatacctattcttttatatttaaagaaaaaaatttaaattaaatgcagttttatcgaaatatgttgtgtcatttttttttttttgtccaaaacaacatagctgttctgcagtgagtgtatggagacaggtgttatcatatactattgataggagagtaaattggcccagtcatttcagagggcaatttgactgtatttctcaaaactctaaatgctcaaatccaataactgataaactctatttctaagaataagtcctgaaaagactttcagctggggctatacgatgtctgtgcaaagggccccctaccacattctacgacatttttatgtaacagtaaaatattggaaaatacctctgtatccaagtctggtaaaataattttgttgaatcaatataatggattacttgtagccaataaaaataagaagatgtgtgtgaaaaatgtatcttttaccgaaaaaaaagcaagttgaaaaaacaaaatctagttacaatacttttttacataaaagatatacacataagtgaatacatatgtgcatgtataaatgtatgagcccatatgatcgtaagaaaaaggtctaaaatggtatactctaaatagtctactactgggaattcggactgagtggctaagtgagacccctttctctttctctttctctctctccttcgaaaccgggtctctctctgttatccagactggaatgcagtggcacaattatagctcactgcagcctggagctcctgggcttaagtaatcctcctgcctcagtttcctgagtagctgggactacaagctcatgccatcatgcccagctagttatttttgttttgttttgttttttgtttttgtttttttttttagatagggtgtctcactatttctccaggctggtatcaaactcctggcctcaaatgagtcttctcctgggtcactgggattacagtggtgagccattgtgttccacctttctttttatttttgagacagggtctcactctgtctcccaggctccagtgcagtggcccggatctcagctcactacaacttccacctcctgggttcaagtgatcctcccacctcagcctcctgagtagctgggactacaggcacacaccaccatgcccagctaatttttgtcttttttggtagagatggggtttcaccattttggccaggctggtctcgaactcctgacctcaagtgatcctgttctgtcctgtaaaaaaataaaaaataaaaaaacactttcaataatatgcagcaagcttttgtttgggaggggagataatatgtaaatttaaactattaacttttctttaaggattactacaaaaatagattttaattcctatcattatggactattaacattttatattctactatttcaagcagttatgctaatttattttagagattcttcaactcttcttttccaacaaatattttataatgatctataaagataaaaaaaacagagccagtaaattatgactttcctgttatactaatgccacacattttatgattgtagtgacggaggtgtctgtcatgaaacaatgactaattgtaggaagtacaagccttctttaaaattaatgaagcttcagcaaaataacaaaatatgaaaaaaatcaaaattattttttacttcaaatatacatttttttcttttttttttttaattgacacaaggtgtcactctgtcacccaggctggagttcactggtgccatcgtggctccctgcagcctctacgtcccaggctcaatccatcctcccacctcagcctcctgaatagctgggactatagtcgcatgccaccatgcctggctaatttttgcattttttttttttgtagaaatggagtttcgccatgttgcccaggctggtcttgaactcctgggctcaagcgatctgcccacctgagcctcccaaagtgctgtgattacaggtgtgagccactgcgcccagccaattttgcaaattgaactttcaattataaaagattatttgtcttacttaagcattgttgtcctactaaactattatttctatgcattaattatgccttggtgactttaggtttgaaatcaaaacccattttcttttatataatattaacaacactattcagagctaagacgcattataactaatgatgcattatatacacttgattattaattttgctttttaagtgaataggaagagtggatatgaagagaatgcccacagtcctcattgctgtggagatttgctttccacgattttaaatcagggttatcagaaaaatccagtttctccctagaaaggtttaattagttacatttgttgaaaagtttgacacattctagatgctttatatttaagactgttttataattaaatgccatattatgaaagctcttcttgcttctgtattaacttattaatggatattgaattaaaatcataaaacttaatcctcactgttgaatatttcttaaatctcaactaataaacagttggcatatggacattcttattgaaatataggacatttttactggtgaatacatttttccacttaaaagtttttatgctgatataatataattggttccattaagctattataatataaattgcattcccctaaggtcattttagcctttatacatggttaaaggctttcatgagttatataaaactcagagctgtcaatgaatttactattgagtagcagactgccaagtagactgaacaactgaaaaaggggagaaaaagcaaaataatgataaaagtagataacatttatatagagctcactacaagtcaagcactttttaaattgtctcatccatattaattcatctaattctcatagtgatcttggaggttgatccccttatcatccccacattgcagaaactgaggcctggagaggttaagcaatttacctgttgtcatacaggcagtaaggaattaagctatggtttaaccccagatattctggctccagagcccatgctttgacttaaccactcttacaccgcctctccatgcaaattgctgttggatgattgaaatggtatgggtgcttagaatcaagtgacatataaggctgcagacaaagacagacctaagattttatcattttaattcactaccactaaacaattggccagaacttggactttctggccctgtacttatttctttcatagtctacaccaacatatttgacatgattccattatgctgccacaagtgatagactataaagagaagtagttatttgcttctaatattttgccagataattaatatagaaaatgatacattttttctcatcaaatgcaccaatgcatttttcactggaatatgaaccctggtttgcagaatggggctagtctggggcaaattcgcgactgccgccttgggttccaaagaccaggctgactcaggaggaatattactcaaggtaactgcagtttgtaaaacatgagcaaaaagaataaaaaaggaaaaaaaaaaagatcagagctgcaagtcacttgcatatggcaatcctgcaggcatgttaagaatgaaaacagctgggtgcagtggcatgcacctgtggccccagctacttaggaggctgacacagaaggatggctttaggctaggagttcaaatccagcttgggaaacatagcaaaaacctgtctaaataaataaataaataaaacaggatttaaataggaaaatgactagtgaaggaacccatcaggcaccattgttctagtcaaaactttagcattatcctagttggttatttccctcacttctctactgtgatatcagagcctttaggaagccttgaggttcatttccaaaacaaagtgagacatgcccgtgtttgccattgccatgactcctgcccgctattccaatctgtggtcctctcttcccaagagctcagccttggccccagctatgtgtccatttccatggcttttacacttgccctctcctaggttgtatccatgacacacagcagaggtttttaaattagaaatgagatcatatcactctcctgactaaaactcatttcagtgaaaataagaaagattgatatattcccatatatgttagaagaaagttcaaactccttgtcaaggcccaaagattctaaataattctgcctttctctaactccatctcatctcttctcccacctcctcccatcatgcttacttatttccagttatactgtttccccttcaattctgcaaatagccacactgtctcttgactttgtactttttttttccttctgtcttgaatgctcttccctagctcttcaaatgcctggctcagtctcactcagttctgggctcactgtcaccttttagagaaaccttgctgatcagttatttaaaacagggctccttatttattttctatcacatcaccatatttattttcttcacagcagttgccacagtctaaattatcttgcgtacttatttgattacctgtgtattgtctgctccagtagactgtaagctttaccagaacagcaacctattctgcctcatttgaagtgtgcaccctacgttgagcaaaatgcctggcatgtagtaagcaagtggtaaatgtctattgcatgaataaaactgatggtgaatcagtgtccacaaatgagccaaggaaaatggctcagggctgagaccatgggcaatgaacaagttctttgcactgtttgtgagaatagaaaggctggacgcagtcacattggggttgagtcctcaaactgtaataagcacaaataaaatgatgaaacatagtaaaagattgactgttccctgtccatctatctatcaatcatttatctgtttacctgttgcgtgtgtgtaatgtctacagctttatccttccataaaatgcatctgtatttggtaattttcaaatttaatcattatacgagcataattaaaatataggtgtttacatttcattttaaaaataaacacaaacacttatgagtttttagaatgcacaagtaagtggaatatcttgattctcaatctcagattaactaaagatatactttgtgatgcggcagtcaatttatatggttaaatagtgtatcattgaaatgtttgcacataatatgtgtaacaacgtttgaaataatgaaaccacaaaagcaaaggaaataattttgattaaaagtgaacatgtctttttggaagttaaaataatcaaatggtaaaatttacttctaataattgccatatttatttttttgccttccttttatttagagactagtaaacctatcccacaaacttctaaaagcatacagatgtgagaaaaactgaaactgaaatggtcattatttctaagtgcaggtttccttttcaactacagctgggttttgagcatatcttaattaacaaaaaaacttaaagaaagcttagcaaactttgaaggaggaggtcattgcattaatgttctttccaccattctcagcaatatcatttacacctgcttccctgaggtgttattccatatgccccttctggatataactatgtagggagtgtaagaatctttgcaaattgcttcaagagggtgatcatgattttaactgccactaccaatcaaatctgaaggtccatttatttaatgaacatgaattcatttaaaaaaggaaattaccaaactcatcatttaataacaaaaagggaaacaatacaaataaatagcataattaaatagcaaaaggcaatgagaatccaagcattttgagtatctgcaaaaggctaacaatgaattttacaaattaattgttgtaggacaggtttttttgtttgttcttttctcaggatggagtctcactctgtcgcctaggctggagtgcagtggcgcaatcttggctcactgcaacctccacctcccaggttcaatcgattctcctgcctcagcctcccaagtagctggggattacaggcacacaccaccatgactggctaatttttttttattattatttttagtaaagatgtggtttcactatgttggccaggcttgtctcgaactcctgacctcaagtgatcctcccacctcggcctcccaaagtgctgggattacaggcgtgaaccactgcacccggcctaggataggttttctcattgccattccattagagttttgaaaagaaatctattgaaaatctcattgaactatacacttatatcagtgatttttaaggcatataaattacacatcagtaaagtggctagaaaagttatataccaaaacttttttccaaccatatctctactctgcatcttcaactttgttcagtctatgccatagcactttctcctgtatccaccatgtattgcgttacccaaccttctgctgaacctaaatttcatcacatttttaaataagtaactctcctcttggaccttaggcttgagataaattttccacttttgagggatttttttctaaactataacttcatataatttcaccccttgatttttctatcctctcttcttgtctcctctcatgtcatctcctttcttctctttccttccttgcttcttttatcacttttatttctggctatatagtcaattcatttactcagaatgtcacccatcctaatgcatataaactgtgaaggactggcacttctctgaggctctgaggttactcttactttcgaatggaaattggagttcttaagcactttcttaaagctaaaattagtaggaatggctattcatttcgctcacgtgaaaagtgtcagaaatatcttggatcttattgaggttttatttctcactactagtacaagactatactccttgagtgtggagactgtcttttttttttttattttgagatggagtctcgctctgtcgcccaggctggagggcagtggctcgatctcggctcactgcaagctccgcctcccgggttcacaccattctcctgcctcagtctcccgagtagctgggactacaggcacctgccaccacgcccggctaattttttgtatttttagtagagacgggggtttctccttgttagccaggatggtctcgatctcctgacctcgtgatccgcccgcctcggcctcccaaagtgctgggattacaggcgtgagccaccgcgcccggccgccggagactgagtcttgttcatcttcatgtgcatctcccataattgaatgtctggcgcagtactcaaaaagtagtattcaccaaattttatgtacccaagagttccggagaagtttgttgcttttattattgcccttgttcactgaagcaatcgttccaaatgccaacatagggtcctacctacttcttattcagtaccgaaggtccacacctatgtggtatcaaatgatcattttgtaaataatatgatctctgtcactttactaaaaggataaataagctgaccacatatgtgagaaggaggagatggcaaaaagccaagactcttccttctgcttccttgctcccagactcttcaggaccttaccccataaattatcattttttttctcatctactgctaattgatccatcttctaagcaaacaatcatactccaaacactgcttttaaaaacaatctctccttaggtcctttccccaggatatagtcatttttctctttttgtagccctttttctcatctatcgttcgtcaacaatttatcatcaatatgatctatgctttatatccatcagcttcaatctagctttttcttctaccgctattatgacacttcttgtgaaacgagcacatatgacctcttaatcgttaaattatagagtttatacattgtttcttgtattttgtttacactgaataaatctatagaatttgtaataattgctaaacgggtgaaatcactgtagcaatttcagccttgcttattttcaatggcaagtaaacctcattctgcattgatggtgaattcgaatgcaaagatatttatttaccatctgcaattaaaaaaaaaaggtatgggggaaatacaatgaaaacaccaaacagtatttttatctaaaattactatagagtggtacaaacaaccatatatcataaactacattatgttgtgaaacagactgtgatgatggaaatcaagtgtatattagacagaagggttattctaactggaaggactgaggggtgaggtcagggctgctttaaatgttgttttccttatttttttccctgcctttatttttcttctttgagctattgttgtttgagtggttaataacacttctcagttcataggacattgtcatcaggggtctatgcaaggttctcttatattttatgaatttatttacttcccgtaacttcattctccactggagaaaattttatacagaagatcacataagacctggacctgcgtggatgaatagtaggatgtccacagaggaagtgaacggtgctccaaaaagagggaaaaggggaacagaggtaccaagaagtgatcgttgcttaagtctggggttagtggcagcatatatgtctggaaagattgttgcagcaagttgtaaaggtcttgatatcctgtgttaatacaattgcaacacaatgacgaattttgagcaaatgggttactggatctggctcatgtgagatcattctaacagaggtatagagaatctattttagaaactgggtcagaacaaagataactgagaaagaacatagaagaaactggactggggagattactttgaaggtggttcgttatctaaatcataatcacaattaagatttaaggtaacatttcccattgatacagaagtttaaaataagacagacgtctatatgcaattgatcttttcttccatactggtcctacagacctgatgttaaatgctttttaaagtgctcttgttatccctataaacattggagcttggtttccttgggaaatgtaagagcagagtttattagtctattcattcctagtactaaaatataatggatccagtggtagaatgaaagattcagtttccttaacttgccatatatcttttattacattagtgatgtgttttcctgatatttgtttccttgtaaactgtacttttctctctttctttgaattagttgctgtcaaggtgaatagctgaataatcttgcattaattattaatacttcttatgccaaagctaattaatggttttgcacgatttaaataaactacagtcttatataaagaaacagctactttctttagaaagctaacacatgtataaacatgtggtcataatttgaacatattaataatgtaagtttccaacacaatcatataaagagattagaaacaaggagatcctaagtcttctatgatggcattctattaaaatccaaattgaaatgtgtgaaaaaagtcacttaaatatatgtgcctataatctatctatctatctattatctatctaatctatctatctatctcttttcagccatctatctatttattttactgccttcattacctacaatttgtttgtgattctccagattcctttttttccatgttatatttatcaagagttttgattttggtcttggattttctgcgatttctttattattctacatttaattatttttataccccaacagttaatgtgataacctttttctattaatatccctttctccattcaagtatttatttttctctttcctctctggcatttctctgtgaaggaaccttgacagctttctatcgtggtgtctttatggtgatagcacagacaccctttgaagttaacatcttgttttctcctgaagatagtttctactccttctttattttctttgaccccagcccagacttcaataatgcattgaacttgctgtcgctgatagtccttctgctggtatttcattgctgtctctcttgctcagggtcagggacaaactctcagctattctcacaagattttaataggcttttactggcacttaacatttataaatagcaaacaacaaatgacacttctgttgcatgtgctacaaaataaggtttttgtacattgaagaacatatttcttaaataaaaaaattaaataatgtctctataactacataacagaaaataagaccaaaccataattatataaattaatattatttggaaactttttagaacatgttttatatttttatgagtacatgtaggcttggttatgctggagtaaaatatcaacaggaaaacaccagtgtcttaaagcaacagttacagccctagccaactgtccagggcagctgtcatctcagtttttggctcactagttcagactccgtgatcatcaagagaaaggtagagtgttcaggaggatccacaccagtagtgtaaggcattggcctaaaaaggaacaaagttactttctctgaaaagcccttaaccagaattgttcacaggtttttacctaagtgaaaagaaaaaatgaaaaagacacaaaagggtaattctcttaaatagctacagaagtaaataatcagatatggataaagactagaaatttctcccacaacatgatacaatagatttctattttactgccaacaacatattaattctactttactccgtggctacaaactttggaagatgttattagcaagcattagaagaagaaagagagataatttgttatggatgaggcattcaaatcttgataaatataaacaaagtatttgggactagaataaataatgcaaatacaaggtaaaataaaaaggatacatcagttagaggacagaaccattttgagagctttttggagatgagtgtggaaagaaaacagaaaaagtggcagagagggattgtatggaggttgtgaatggtgactattaaaaacactaaatgctgatatccacatatgctcatgtccaggcaagtccacagatggaaagatacttagctgtagcagaaataaggaatgggctgtgaggtttacaagaacagaccacccaacacctatgtgaaatgaaaacctggccaaggaccacagtcatgaattcaacttcattgtccagaaaactaactcatgcctcatagaaatattatggaagcatccattcctttttacataaagcccaattttaccgtatgcaaaaaatttacagagcatgcatatgcttgcaaataattcattttctgtgccctttattttactcataggttgaagaagtaaagaagtgtcacaaaggaaagatcttctgggtcctaacaggactaatatcagtgcccaaaatgaaaatgcattcttctgcatacctagttactgtttcggctggtgtttcttacttacagttaataaaatgttagacatccctctagttcacaggttagccaccccagctccccattcagagctccctagtgggaagctgttgagcctaaaattcatgattgtcagcctccaacagagaacttccacagattgctgctgctacagcttcaggatccaatccaagtcctgctttatgccagtctggtgtttaacacttagtctggtttattacttccaatcagtcctttttggggttatgttaactgaaattagtttctgttgtttgcaaccaaagaaccataattaagactgccctctccactccccacacagctgagatttttgcacccaagttgactaagaaactcctgaaaataaatagcaggtttaagatcctgttctagagagctgaatcacaagacatttaaaggagaataaacagggttcagttactaaattcctttactggagaaaatagtcaaaaagagaaaaagcaaacataactaaagagttttaaaatcgatgacatcagaagaatgtggtataatcaatagttacaggaagttagcctgtgaatgacttgtagacagtcaatggtattcacatatgcatacgcttccataaacctgttgttctttctcaactattccacatatggaaggggcatgtgactcctttccctctcctttattgattttcctcatggtcactattccaactgcactcagctagcggtagttgtcttaatatgtcataccctttaatgtgtatgtttttgtgcccaagttatttctccttccttggagtgacttttctcccttgtttgtctgtcacttcttagaatcagctgtcactctttgaaatctcagagtcaataacaagaacaactacaaaaatgatcactcactcactgctttctccctacagttcccagaacctactcctagtattccatttgtcaaaatgcagtttagtatttagttgcgtctgttatctttaatccactgtgacttcctaaaagtggggctgtgacttacttgtcattgcatatctgggaggtacttggtacttggcacagggtgaataatacttttttttttttccacacagatgaatgaataaattagtcatctagggttaagatttttccacctcaaaatctgacacatacacacctatttacaaaaccttatagaaccaagtttagataaaattaataaactgaaaactatcctgtccttttatatttaggttgtaaattcaatgtagataatggatggattcttattatgtgtgtgtgtgtgtgtatatatatatatatatatatatatatgaatttattttttaacagaagcatccaatgctttttacataaaacccaattttaccctatgcataaaatttacagagcgtgcatatgcttgcaaatacttcattttctgtgccctttattttactcataggttgtacgactatgtgcccatgtgcatgtatgtgtgtgtgtttttatacacatagatgtgtgcacacgagtctacatgtttgaatagattttgagaagcaattgtaatgcactattataattgaagtccaaattgactgcaactatgtcaatgagtgctgaatcaccagcctcactatttcctccttgaatagcctttccgtcatctccattttctcgagtaatgctccctaatcctacactgtaccttcactcccttcttgccttctttccattatgtttattcttcacggaactgacatcaactttattttcaaacagtgacttcgttttcaataaaccaagctagaaaacccaattctgtatgtattctgggcttggtttttttctgatgttaattcaccatattaagtttttgtcttggctctgcacaatctggtgattagcatatatgtataaaatagaaaagagcttttatatttaatgtacttttcatgcgcattgaaactctgggcagaagatgtggggtaaatgcaattactatgtagagtagcatggtaaatctcaaattacatgagaaatttacctagaattagatcagatacatagatgataggtaggtagatagataaattttatttaaaatgatcgtcatcaggagtgaatctccaaaacattgtgaagctgtagaacttatattgggtatttctttgattgcctgtgctcatccattcttccctttatgcaagcatccccctctggacctctcactcttcctcctcccacctaccctaatgggaattacccaccatgactgcaggccctccaggatgtggttcccaatttcctgtccctcagagtctcaactgccattctctagaccttgtccctgacacctatacttgacatactgtcatgtgctgtcctagagttctacttactcattatattcttttcaggtattttcttttcgcagggtcacactatgtgaaatgctcttatctcccctgggagcctgaaaaatgcagctttatcttgaaatctcagttcttctgagattacctgctccagaaagactcttccaactacacagtggttatttagatgaaattacctctattttctgccttatcaattctaatattgcacttgccatactgcatttatttctgcatagaatttttgtgtgagacaaaaggaaaaaatgcacccaattctcaagcactccctgtattctacaatgttccttcacggtgtctggccgttttgacgctgagcttgaccatgtgactcactttagccagtgggatgttagcaaacgtgaagtaagcaggggcttgaaatgagcttgtatattgaggcttctttgctcttgccttttgccattgccaggagaacctgcccagaggagcctgctggaggatgaaggacacgtggagcacagccatgtagcccttgtcatctcagccgtggccatcctggaccaaatgctcacctgcaatgtgttcattatacttgttgtggcaatgcataaccaatatggttgctttgcctgtattttgtgacctctttgtgagtgagacatctatgtcttgattaagtctctttcccccattcctagaacagtagttgatctattacattttggttgaattgaacctgttgaatgccgttattgttcctttctcagaaaaaaaaatgagtgctgtatcttatttctaacaggcttctaaacagtttagaacccctgcttaaaggaattctacaaaaaatattgagaactgcataacctctttagagtaatcaacatatgcaaataaccagtttatctacctctttagtgagccttaaactttgcaagagtataaaaaattatatattttttctcaatagtcttcatgtaattttctgcacttttctaaaattggttgtggaaattgtgcccggttttagagtggggggaaccagcaagtttggaaacatcatcagtgttcttgttttactcgtcttttagtaaacacattaggtctggacaaagtctaatgtatgtgcaagttcaacataaactgcatcgatcaattaagtaatctctccttttcatgtacttgataaagtactatttctcatatacatttttagaataaaaattacccataaatttgcaagatcggcaggtataaccagataaagacagttttcacttttgtataaataatgaaagtcatgcactcaagatagggactgtggaaagactaggaattctaggattcagcatatttgagaagattgctctggcccccctcatgaaggacttttcattcaagctttgaaagattcaatctatgcaaggatgtttctctaagctgctagtccaaaagtaataaacatcaagcttacggatgggtgtggaaactgaatggctttgcttttcttctgagggatttaatttatttttaatatcacaggtggcttgaggcgaggtgtaatcatctgtcactcttcagttaaatcatatcacctcacttctgaaatattctttgatctctctacctgtaaatcacgttctactttctctactatagactgtagcatatagatataataatgacatgacaaattaccaagagcatggagagtatgtctatttaaaagatgattgaaaaacacacacatgcaaatactaacccagacatttactttttaatgtttttcttcttttttgacttgttactagaatataaaattatatgaaacacatactgaagacaagttttaattttttttaatttaaaacacatcaggcatttcttttttactggctttatagtttaggcaatattaacaccttacatctgtaattttagcattttgaatacacagtttttaatgtacattatccattgggcagatccatagaacaagctaaaactttccagattcacattactttaaaaatattttgatttgctgggtgtggtggctcacgcctgtaatcccagcactttgggaggccgaggtgggcagatcacgaagtcaggagattgagaccatcctggctaacacagtgaaactccgtctctataaaaatacaaaaaattagctgggcgtggtggcgcacagctgtactcccagctactcgggagtctgaggcaggagaattgcttgaacccgggaggcggaggttgcaatgagccgagatcgtgccactgcgttctagcctggcgacagagcaagactccatctcaaaaaaaaaaaaaaaaaaaagatttgttgtcatatgtcttagttaacaaattttctgagggggtcattgggtaaagtatgcctcactagattatgttaggaaaagtgatgggacattaatttgtgttattccaatataaaaagggcctcttttcttcccccaatcaatctaactattaaatcacttataagaaacttaaatgtcacaataagataccaactgtcttgaataaaagtcatagatgcacgcctgtaattccaggactttaggaggtcgaggtgggtggatcacgaggtcaaaagatagagaccatcctggtcaacatggtgaaaccccgtctctactgaaaaaaaaaaaaaaaattagctgatcatggtggcatgcacctgtagtcccagctacttgggagtctgaggcagaaggattgcttgaacccaggaggcggaggttgcagtaagccgagactgtgccactgcactccaacttgagtacagagcgagactccgtctcaaaaaaaaagaaaaaaaaaaagaaaaaaattcatacatggaatgcctttcaaggaaacattaccttaaaaaagtgtaatattataataatcaaaatagccaaattcatataattttacaaaaaaacaagatttgctgaaacggtgaatcaaagaagtcattgtgaaaacagctttagctgcataaatgataaaatctagaaatagggatgagtgttattgaaaagaaggcttctgtttatatgaagaaggaagtctgaagagataagggaaagtgatatactggctgagtgtcctttatgcaaaacccttaggaccagaagtgtttaggatttaaaattttttagatcttagaatatttgtatgtacctaatgagatatcttaggaataggaccgtcatctaaagatgaaattcacatatgtttcctatacacttaatacacatagtttgagggtaactttatgcaatattttaaataattttgtgcatgaaacaaaattttggaaagcaaaggttccactgtctccacaaaccatgtggacagtctgtagttgattggcatcaccatgatttctcactctgaatttatacactattgataagcaatcatcttcttacacttatttgcacataagtacttaacagcaaaaaaatgtgacatggtattttcagcttattttctaataaatacttattagtcatataactgctatcctaatgtttatgttgttagatcaaaaaaatgaataagtatgttaaaggacctcggacttccaaaataaattggtgggcattattgatgttttatttctctgaagcctaccaactccatttcctgattcttcataggactttttgacatattgcttcaaactcttagatcaatgacatattaatccctagatttaaaagaattattgctatattaggcagtatgcatttagttgcaagtaataattttttaaaaggagctgatcaaaagggaatatttattataaggatacagtcatagtgggcagcaatatacttaggcctctggaatgacctgagagagaggactggacagaagtcttctctctgtccttgtgtttcttatctgaattcatttgattaatcagtatcttgatcaaaaataaacagcttactctaactgagtaatttgggcagaataaagagacatcttatacagacaaggtatagcacagctccctggcataaggaagaccaaggagtcatttccacatctaggtctggaggagaaggagcagaacagaaaacgcacagaggaaaactgcatgggaaggacaccagcaggttagcgctgcccctgtatctcagaactagcagcaggaatactccttaagatgccattttttggacctttcttccattgtctcatatctctttctaaccagagctgggaaaagttctccacttttcagggttcatatgatttgactgaacacacttagatgacccaagataatctctccatctcaatatcatgtattcctttgggttctgtaaaatgcaaattgtcctggaatacccaatgcttgaagcacttttttataaggtgtggtgcagttgtagtgtaagaatttaacccccatgagagcagagactgttttccttatcctttgttttgctgtatcttcaggatttagaatagtatttggcacataaaaggagcaaagtaaatattagttgactgaatgagtgagtgaatgagtggagagagcaatgccaagagagagatctgtagttttgagaagtaacatataggcaaagagagaggtttcatcaatacagcccctgccattatctctctcccggattacttccaagagtcccactgagtttttctgaattgcattaatctcaaatccattcctcattttaagactaaaatgggatttcttttgccatgtcgaattattcacttccttggttaaattccaactgaggtttccttttgcctgttgtataaaatcaagttcttacaacacccttgaagattggccccgagtacctttctcctcacattgtgctctgcagctgcattaaaaatgttctctttccttgctcacctcctgtcctttcttatcttgaggcctttgtcggtgctaattcctctactttgtatgccctgccatcttgagacacccttgtctgtcatctttgtttgttcttaatactaaacacaggtgctccaccctccacaaagcttcccttgacacttaaactccaagtttgctcctagaacctcctctgtatagttttctaccaccccagaagatgctgcatcttgttttttggctgtgtctcctatcaacttgatgtggggaaaagcaaagcaaaataaaacaaaactttattagtgccagaaaaaaagaatcatcaaaaggatcaccctttagaactatatattatacttcctgctaattcattccacttttccctgaggaaatgctatgtacacatgcatgtgtataaacccattgttatgttaattcaaccaattagtttttttttaatttatcagtctcctttttcctcatgaccatccctaaactcagaatcaaatttccagctcaattatatttaatctggtatatttcatggtctctacatttatggggttttttttctccatcttttctacacaagaaccaatctagtattgggccctcattttaattagatttttatcttgtttttaataattcctatatatgtgcttttttgtaaattttaaaatctaattcattaaactttaagttagtgctttttgaacacctaggattgccataaaaagaaacaaacacgcataaaaaattggggggacatagtttctagaaaggaaaattcttaccactgatattttttcttttccgggagtcaataactccagcaaataaatacttccaaaagaactgtgttctgtaatgtggaaatgaaaaacaaatctagttaattcattcagaagatttttctgtacctgtatttaggaataaatttgcatcttttacattggttccttttgtcattattgtaaatagccttggatggtaataacccactccattgctcataaaacccatttgatctgtgtttatcacttgctctataagtagctcttcatttctgtttgttgctatcatggttataaaatatactactataatagttcttaaacatacaatagcgctataaaacagtatctttggtgggtatttaagcaattttaatgctgagacaaaataatttaatttcctacccatatgttgaacgttccttaaggcactaaaaaaatctctaaaatccatatgcttgaaaatatctaaatttctgccaaacttagttcaggcttattagtaattcctaacgagtgaaatcattgtgattatacaagaaaaaattgattaaggtatggcagctttctctactatccactatttcagagctgaaaacaatacgtatatcagatcttggttctgtgacatctaaaagtatctacaacatttgtgagcaagaaaatgtagaacctatcaaataaactttgagaaccattaacttgttttactctacctgtaacactctctatagagctaaattaacattctttgtattgtcatttcaataaaaatgttatgactctttcatagttaaaatcaactttttaaattttcagtgctaaccattatcacttaataaacagcagttagattttgacaccttgatttattttaaagaaaagttaatatccattgagatgtgaattttacataaagagaataaacaaaatcagatgattatcttaatagatgcagataagccttgataaaattcaatatctcttcatgttaagagccctcaataaactaggaattgaaggaacatacttcaaaataataaaagccatctatgacaaacccacagccaacatcattctgaatgggcaaaagctggaagcattccgcttgagaaccacgagacaacaaaaacctctctcatcactactattcaacatagcactgaaagtccccgacagagcaatcaggcaagagaaagaaataaaaggtatccaaataggaagagaggaagtcagtctacccctgtttgcagacatgattctatagctaggaaacctcatggtctctgctcccaagctctttgctctgataaacaacttcaaaaaattttttaaatgtacaaaagtcaggtgcaattccaaacactagcaacatccaagctgagagccaagtcaagaatgcaatcctattcacaatcaccaccaaaagaataaatcatctaggaatacagctaaccagggaggcgaaagacctctacaacaagaattacaaaacactgctcaaagaaatcagagatgacacagacaaatggaaaaacattctatgctcatggataagaaaaaatcaatgtaattaaaatggctatactgcccaaagcaatttatggattcaatgctattcctaccaaactaacaatgacattcctcacagaattagacaaaactattttaaaattcatatggaaccaaaaaagcccaaatagccaaggcaatcctaagcaaaaggaacagagctggaggcatcatgtcacctgacttcaaactatactacaatggtatagtaatcaaaacagcacggtactggtaaaaacaaacaaacaaaaacagacacagagaccaatgcaacaaaacagatcacctacaaccatcagatcttagaaaaagctgacaaaaataagcaatggggaagggacaccatattcaataaatagggctgagataactgattagccatacggagtggtttgaaaatgaccgcttcctcataccatatataacaatcaattcaaaataaattaaaacttaaatgtaaaacctaaaactataaaacttctgaaagataacctaggaaatactattctggacataggacctggcaaagattttatgacagagtccaaaagcaattgcagcaaaaacaaaaattgataaatggcatctaattgaactaaagagctactgctcggcaaaataaactatcaataaacaaacaacctatacaatgggagaaaatatttacaaactatgcatccaacaaaggtttaatatctagaattcctaagaaacttaaacaaatgtacaagaaaaaaataaccccactaataagtgagcaaagaacatgaacagacacttaccaaaagaagacattcatgtggccaacaggaatattaaaaaatactcaatatcactaatcattacagaaatgcaaatcaatacgacaatgagataccatctcatgctagtcataatgatgactattaaaaagtcaaaaattaacagatgctggtgatattacagaggaaagggaatgcttatatactgctgatgggagtgtaaattagttcagccattgtggaaagcagtgtggtgattcctcaaagaacttaaaatgaaattatcatttgacccagcattctcattactgggtatatactcaaaggactacatattgttttatcataaaggaacatacatctgtatgttcattgcagcactattcacaatagcaaagacatgagctcaacctagattcccatcaacagtagactagataaagaaaatgtggtacacatacatatactatgtagctataaaaaaaaaaaaaaaacaatgaaatcatgtcctttgcagtgacatgggtgaaactggaggtcattatcccaggcaaacaaacaaaggaacaaaaaaccaaatactgcatgttctcacttatgggaactaataaatgagaacacatggacacaaagaggggaacaaaagagtctggggcctacttgcgggtgaaggctaggaggagggagaggaagagaaaaaataccttattgggtactatgctcattacatggatgatgaaataatatatacacgaaacccccatgacatgcagtttacctatagaacaaatttgcagatgcacccctaaatctaaaataaaagtccaaaaacgaccaaaaaaaaacaaacagaaaagaagtaaattttgtgaagtctttagtttataagttaaatatgctcaaaacataaagaaatcaagagttctagagtaattgtcatttatacaacatgaacaatgcaaacataaatttgaaagcttacataattctcaaaagaaccacaaattattgaaaaaataaacattttctatccatgtagatattgaccaaaatttttatagaaagagattaatgaataagcttaaattgtaaaagcaatctattgacatttccaaacctattgacttgatttattccagtactataacagtatataaaattatatattctatttataatagtacatgtaaatattacatacatagtattagtttactacataatgcatacagtattagtttattatgtaagcatatgtaactatacatatgtagttattagtttattcaccaattcaagtattcatcaaacttaacaaacatgtatttgcttacaacttactcaacatctgaaactgcacttcgtatcgaaggtataaaacttagcaaggtcagttttgcctgccagagctctcattcatatatgggagctaaatgagtggatctcatgaagattggtgatcaccagaggctggaaagggtagcatgaagggaaggtggttaatggtccaaacatacagtttgataaaagaaataagacgtggtgtttgatatattagcagggtgactatagtttacagtgatctataatacatttcaaaatagctagaagaaaataatttaaatgttattagcatatagaaaagacaaatatctagggggaggagccaagatggccgaataggaacagctccggtctacagctcccagcctgagcgacgcagaagacaggtgatttctgcatttccatctgaggtaccgggttcatctcactagggagtgccagacagtgggcacaggtcagtgggtgcgtgcaccgtgcgcgagccaaagcagggcgaggcattgcctcactcgggaagcgcaaggggtcagggagttccctttcctaatcaaagaaaggggtgatggacggcacctggaaaatcgggtcactcccaccctaatactgcacttttccgttgggcttaaaaaacggcgcaccatgagattatatcccgcacctggctcggagggtcctaccccatggagtctcactgattgctagcacagcagtctgagatcaaactgcaaggcggcagcgaggctgggggaggggcgcccaccattgcccaggcttgcttaggtaaacaaagcagccgggaagcttgaactgggtggagcccaccacagctcaaggaggcctgcctgcctgtgtaggctccacctctgggggcagggcacagacaaacaaaaagacagcagtaacctctgcagacttaaatgtccctgtctgacagctttgaagagagcagtggttctcccagtaggcagctggagatctgacaatgggcagactgcctcctcaagtgggtccctgacccctgacccccgagaagcctaactgggaggcaccctccagcaggggcacactgacacctcacactgcagggtactccaacagacctgcatctgagggtcctctctcttagaaggaaaactaacaaacagaaaggacatccacaccaaaaacccttctgtacatcaccatcatcaaaggccaaaatagataaaaccacaaagatggggaaaaaaccgaacagaaaaactggaaactctaaaaatcagagcgcctctcctcctccaaaggaacgcagctcctcaccagcaatggaacaaagctggacggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgtgatcaactggaagaaagggtatcagtaatggaagatgaaatgaatgaaatgaagcgagaaggaaagtttagagaaaaaagaataaaaagaaatgagcaaagcctccaagaaatatgggactatgtgaaaagaccaaatctgcgtctgattggtgtacctgaaagtgatggggagaatggaaccaagttggaaaacactctgcaggatattatccaggagaatttccccaatctagcaaggcaggccaacattcagattcaggaaatacagagaacgccacaaagataatcctcaagaagagcaactccaagacacataattgtcagattcaccaaagttgaaatgaaggaaaaaatgttaagggcagccagagagaaaggtcgggttaccctcaaagggaagcccatcagactaacagtggatctcttggcagaaaccctacaagccagaagagagtgggggccaatattcaacattcttaaagaaaagaattttcaatccagaatttcatatccaggcaaactaagtttcataagtgaaggagaaataaaatcctttacagacaagcaaatgctgagagattttgtcaccaccaggcctgccctaaaagagctcctgaaggaagcattaaacatggaaaggaacaaccggtaccagacactgcaaaatcatgtcaaaatgtaaagaccatcgagactaggaagaaactgcatcaactaacgagcaaaataaccagctagcatcataacaacaggatcaaattcacacataacactattaactttaaatgtaaatggactaaatgctccaattaaaagacacagactggcaaattagataaagagtcaagacccatcagtgtgctgtattcaggaaacccatctcacatgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctaaaaagagacttagactcccacacattaataattggagactttaacaccccactgtcaacattagacagatcaatgagacagaaagtcaacaaggatacccaggaattgaactcagctctgcaccaagcggacctaatagacatctacagaactctccaccccaaatcaacagaatatacatttttttcagcactacaccacacctattccaaaactgaccacatacttggaagtaaagctctcctcagcaaatgtaaaagaacagaaattataacaaactatctctcagaccacagtgcaatccaactagaactcaggattaagaatctcactcaaaacttctcaactacatggaaactgaacaacctactcctgaatgactactgggtacataacgaaatgaaggcatccttgatgaacattgatgcaaaaatcctcaataaaatactggcaaaccgaatccagcagcacatcaaaaagcttatccaccatgatcaagtgggcttcatccctgggatgcaagcctggttcaatatacgcaaatcaataaatctaatccagcatataaacagagccaaagacaaaaaccacatgattatctcaatagatgcagaaaaggcctttgacaaaattcaacaacctttcatgctaaaaactctcaataaattaagtattgatgggacatatatttcaaaataataagagctatccatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccgaaatctccttaagctgataagcaacttcagcaaagtctcaggatacaaaatcaatgtgcaaaaatcacaagcattcctatacaccaacaacagacaaacagagagccaaatcatgagtgaactcccattcacaattgcttcaaagagaataaaatacctaggaatccagcttacaagggaggtgaaggacctcttcaaggagaactagaaaccgctgctcaaggaaataaaagaggatacaaacaaatggaagaacattccatgctgatggataggaagaatcaatatcgtgaaaatggccatactgcccaaggtaatttacagattcaatgccatccccatcaagctaccaatgcctttcttcacagaattggaaaaaactactttaaagttcatatggaaccaaaaaagagcccgcatcaccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttacatgttagacctaaaaccataaaaaccctagaagaaaacctaggcattaccattcaggacataggcatgggcaaggacttcatgtctaaaacaccaaaagcaatggcaacaaaaggcaaaattgacaaatgggatctaattaaagtaaagagcttctgcacagcaaaagaaactaccatcagagtgaacaggcaacctacagaatgggagaaaattttcgcaacctactcatctgacaaagggctaatatccagaatctacaatgaactcaaacacatttacaagaaaaaaacaaacaaccccatcaaaaagtgggcgaaggacgtgaacagacacttctcaaaagaagacatttatgcagccaaaacacacaggaaaaaatgctcaccatcactggccatcagagaaatgcaaatcaaaaccacaatgagataccatctcacaccagttagaatggtgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaacgatgagttcatgtcctttgtagggacatggatgaaattggaaaccatcattctcagtaaactatcccaagaacaaaaaaccaaacaccacatattctcactcatgggtgggaattgaacaatgagatcacatggacacaggaaggggaatatcacactgggttctgttgtggggtgggggttggtggggagggatagcattgggagatatacctaatgctagatgacgagttagtgggtgcagcacaccagcatggcccatgtatacgtatgttactaacctgcacaatgtgcacatgtaccctaaaacttaaagtataataataaaagaaaaaaaaaaaaagaaaagacaaatatttaaagtaatggatatcccttgggctaggggagggatagcattaggagaaatacctaatgtagatgacgggttgatgggtgcagcaaaccaccaaggtgtgtgtatacctatgtaacacacctgcacgttctgcacatgtatcctacaagttaaagtataattttaaaaaagtgatggatatcccaagttacactaatatgacctttatacattatatgactgtattcaattaccatgatgtacattcactactcattaatacaaatttttttaaagaaaataaaatagatatttaaaatgtggtatgataagtactgtaacagtggatggtagatcttccaaaacttactagttccttttcagtttggcatctacttcttcattttgttaaaataaaacataattgaatatttttgtgtttatcttaatgatattgtaatttacgatttttacaagtatgcaactttatgattttaataaaccttacttaaatattattgtagccaattaagtaaagctaatccagacatctatgcatcaagtttgttataggtggtgacacactgtaaaaatgtgtacacatttatgtaacaatggaattaagtttttaatttattcctgctggtggataataacaggaagtcagggagatggaggcacagttgctatctatccagtcacatattgtttgcgactaagcaccattcaagagaccttctttctgcctcattaaataagttaatcatgtaaatcacagataaaatttgagaatatatggatatagtttacacataaatgatgtatttttattgctgagaataaaaacagatgtgacaatgcccaggtgtcagtcacaaaatattatcattctttagtatctaatatgaatgaatggaaaattaaaaggtcaaattgagatatatatatgtatgtgtatatatatataatctgtagaacataatcaccaatacaaatcattctccataattaaaataagtctaagtagctcaactgctgtgataagaatttaaaatgagccacatatcatatctggaaatggcattgagagactttttaaacagaagctccaaaaatccatcattttatgaacaaaatgtctattaatataggtttagtgagttcatgactcatgtcatggctaaatcctttttatttttcacagtccctcagtactccacaaaccttctactgttgccagcagtattagtagtgtggccagacagaggatgcaacacctgaaagattgatgcagaacaactaaataaatggaaaggcaaacgtaaacatgatcatttcaaagcaaataattacagtcatgtctctggaggcaaatattggcgcaaatttgtcttttcaatcagtttaacatgctttaaaaaacttctctttcgattttgtttgatccatggttatttaggcatatcttatttagtttcaaatacttggggattttccacatatatggttactcatttggaagttaatcgtattgtggtcaaagaacatacactgcataattttaaatgttttagatttgttgagacttactttgtggcttagaatatggtctatcttggtaaacgctttgggtgcccttaaaaatagtgtgtaatctgctgttgtacagtggggtgttccagaaatgtcaattaggacaagtggattatgttgtcgtttacctcttttatatccttactgattttctctctgtcctgtcagtcattgagacatgaatcttgaaatctctaactgtaattgtggaattgtctgtttctcattgcaattctatcatttttgacccatgtatttttcttaatttttaggcacataagcatttatccttctgataaattgacccttttaacccatggtaatattgtttgctctgaaatctactttgtctaatattaagatagcccacacagctttttgttgttgttgttgtttaatgctggcatagtttgtatttttttttatttctttaattttaacatatttggggatagcagattaagatggcagataggagacaggactagccttgtagctcacgcttggaggaacagagcaggatgtggaggctcacatcctcaacttttgctccaagaactactgcaagaatgtaccaggaaagctaagagaatccacacaccctttgaaagaattggatcattgctgcaggctccctgagacactgaaaacctgtgagtctgcttgctttttcaatggggaggttcctggtctggggccaattctcagccctgctcactggttgcctggaaatagactcggtgctgctgtggggtcacggtgggagtgagaccagcctttaggactgcaggctgctgggagcagggtgaggcctgtgactgctggctttcccctacttccctggcaacctggatgagtaagcagaggcagccataatcaccctcggaatataactccattggactgagaaccacaccccgtcctccacatgagctgaatgaagcaagccccgcccaaggagagactgaattcagatatgcctatccctgcccctaccctgtggtctttatctaccagccctggtagctgaagacaaaggtcataatcccttgggagctgtatggccctgtctaccacctgaggaacctgaatactgaaccaggtgtccctagggcaagtttgcatcctgcgcacaggaccacagataatgggctcttgagagcaccacctcctggctggaggccgaccaacacaaaaccagcacattaaacaaaaacacaaccaaggaccctcacagattccacttcactcccctgctgcctccaccaaagcaggcgttggtatccacagctgcaagacctgaaggtggatcacatcacagggctctttgcagacatgccccagtaccagcctggagcccagtagctccgctgggtggctagaccaagaaaagcaaaaagtatcactatagtttggctcacaggaagctccattcctaggggaagagggagaacactacatcaagggagcaccctgtgggacagaagactgaacggcagcacttgaatcttagatcttctctctgacatagagaaggaaccagaaaatcaattctggtaacatgacaaaacaaagttcttcaaaacctccaaaagatcatgccagctcaccagcaatagatccaaagcaagacaaaatttctgaattgccagaaaaagaattcaggtcaattattaaggtaatcaaagaggcaccagagaaaggcaaaatcaaacttaaatcaaaaacatgatataggatatgaaaggaaagtaattcatccaacttgccagtctttgtcttttaattgggtcatttagcctgtttacatttaaggttaatactgttaagtgtgaatttgatcctgtcgttatgatgctgcctggttattttgcccattagttgacgcagtttcttcatagtgtcgatggtctttacagttggtatgtttttacagtggctgatagtggtttttcctttccatatttagtgcttccttcaggagctcttgtaaggcaggcctggtggtgacaaaatctctcaccgtttgtttttctgtaaaggattttatttttcctttgcttatgaagcttagtttggctagatatgaaattctgggctgaaaattcttttctttaagaatgttgaatattggcccccactcttttctggcttgtagggtttctgcagagatatccactgtagtctgatgggcttccatttgtgggtaacccagcctttctctctggttgcccgtaacattttttccttcatttcaaccttggtgaatctgatggttatgtgtcttggggttactcttctcaaagagcatctttgtggcattctctgtatttcctgaatttgaatgttggcctgtcttgctaagagtcaaacacatcggtgggctgtatttaggagactcatctcatgtgcaaaacacacataggctcaaaataaagggatggaggaatatttaccaagcaaatggaaagcaaaaaaaaaaaaaaaaaaaagtacaggggttgcaattctagtctctgataaaacagactttaaaccaacaaagatcaaacaaaggctaagaagggtattacataatggatcgatgcaagcaacaagaaaagctaactatcctaaatatatatacaccccatactggagcacccaaattcatcaagaaagttcttagagacctacaaagagacttagacccccatgtaataatagtgggagactttaacagcccactatcaattttagacagatcaatgagacagaaaattaacaagcatattcaggacttgaactcagctctggaccaagcagacctagtagacatctacagaactctctaccccaaatcaacagaatatacattcttctgagcaccacatcacacctattctaaaattgaccacataattggaagtaaaacattcctcagcaaatgcagaagaatggaaatcataacaaacagtctctcacaccgcagtgcaatcaaattagaactcgagattaagaaactcactcaaaaccgcacaactacatggaaactgaacaacatgctcctgaatgactactgggtaattaacgaaattaaggcagaaataagtaagttctttgaaaccaatgagaacaaagacacaatatagcagaatctctgggacaaagctaaaacatagtttagagggaaatttacagctctaaatacccacaggagaaagcgggaaagatctaaaactgacaccctaacatgataattaaaagaactagagagacaagagcaaacaaattcaaaactagcagaagacaagaaatcactaagatcagagcagaactgaaggagattagagacacgaaaaacccttcaaaaaaccaatgaatccaggagctggtttttataaaagatcaacaaaatagaccagtagccagactaataaagaataaaagagagaagaatgaaatagacacaataaaaaatgataaagggcatatcaccactgatcccaaagaaatacaaactaccatcagataatattataaacacctctatgcaaataaactagaaaatctagaagaaatggataaattcctggacatatacaccctcccaagatgaaaacaggaagaagtcgaatccctgaatagaccaataacaagttctgaaattgaggcaataattaatagcctaccaaccaaaaaaaaaaaaaaaaagcatgggatgagacagattcacagccaaattctaccagaggtacaaagaggagctggtaccattctttctgaaactcttccaatcaatagaaaaagagggaatcggccctaactcattttatgaggccagcatcatcctgataccaaaaactagcagagaaacaacaaaaaaagaaaatttcaggccaatattcctgatgaacatcgatgcgaaaatccttaataaaatactggcaaaccaaatccagcagcacatcaaaaatcttatccaccacgatcaagttggctgcatccctgggatgcaaggctgattcaacatatgcaaatcagtaaacgtaacccattacataaacagaaccaatgacaaaaaccacatgattatttcaatagatgcagaaaaggccttcgataaaattcaacagctcttcatgctaaaaattctcaataaactaggtattgatggaacatactcaaaataataagagctctttatgacaaacccacagcctatatcatactgaatgggcaaaggctggaagcattccctttgaaaaccaacacaagacaaggatgacctctctcactactcctattcaacatagtactggaagttctggccagggcaatcaggccagaaaaagaaataaagtgtattcaaataggaagagaggaggtcaaattttctctatttgcagataacttgattgtatatttagaaaaccccatcatctcagcccaaaatctccttaggctgataagcaacttcagcagtctcaaaatacaaaatcaacatgcaaaattcacaaacaatcctatacaccaataatagacatacagagagccatatcacgagtgaactccaattcacaattgctacaaagagaataaaatacctaggaatccaacttataagggatgtgaaggacctcttcaaagaaaactacaaaccattgctcaaggaaataagagaggacaaaaacaaatggaacaacattccatgctcatggataggaagggccaatattgtgaacatggccatactgcccaaagtaatttatagattcaatgttattcccatcaagctaccattgacttatttcatagaattagaaaaaactactcaaaatttcatatggaaccaaaaaagagcccatatagccaagacaatcctaagcaaaaagaacaaggctggaagcatcacgcttcctgacttcaaactatactacaaggctaaagtaaccaaaacagcatgggattggtaccaaaacagatatatagaccaatggaacagaacagaacagaggcctcagaaataatgccacatatctacaaccatctgatctttgaccagcctgacgaaaacaagcaatggggaaaggattccctatttaataaatggtttttggaaaactggctagccatatgcagaagactgaaactggaacccttccttacacctcatacataaattaactcaagatggaataaagactaaacataagacctaaaaccatgaaaaccctagaagaaaacctaggcaataccattcaggatataggcatgggcgaagacttcatgacaaaaacaccaaaagcaatgacaacaaaagccaaaattgacaaatgggagctaactaaactaaagagcttctgtacagcaaaagaaactatcatcagagtgaacaggcaacctacagaatgggggaaaatttttgcaatatactcatctgacaaagggctaatatccagaatcttcaaggaactcaaacaaatttacaagaaaaaaaaaacaacccatcaacaagtgggcaaaggatatgaacagacatttctcaaaagaagacatttatgcagccaacagacacacgaaaaaatgcatgtatgtttattgcggcactattcacgatggcaaagacttggaaccaacccaaatgtccaacaatgatagactggattaagaaaatgtggcacatatacaccatggaatactatgcagccatagaaaatgatgagttcatgtcctttgtagggacatggatgaaattggaaattatcattctcagtaaactatcgcaaggacagaaaaccaaacaccgcatgttctcactcataggtaggaattgaacaatgagaacacatgaacacaggaaggggaacatcacactctggggactgttgtggagtggggggaggggggagggacagcattaggagatatacctaatgctaaatgatgagttaatgggtgcagcacaccagcatggcacatgtatacatacgtaactaacctgcacattgtgcacatgtaccctaaaacttcaagtataataataataaaatttaaaaaaattaaaaaaaaagaaagaaaaaaaaatgctcatcatcactggccatcagagaaatgcaaatcaaaaccaaaatgagataccatctcatcccagttagaatagcaatcattaaaaacgtgggaaacaacaggtcctggagaggatgtggagaaataggaacacttttacactgttggtgggactgtaaattggttcaaccactgtggaagaaagtgtggcaattcctcagggatctagaactagaaataccatttgacccagccattccattactggttatatacccaaaggattataaatcatgctgctataaagacacatgcatgcatatgtttattgcggcactattcacaatagcaaagacctggaaccaacgcaaacgtccaacagtgatagactagattgagaaaatgtggcatatatacaccatggaatactatgcagccataaaaaaatgatgagttcatgtccttcatagggacatggatgaagctggaaaccatcattctcagcaaactatcgcaaggacaaaaagccaaacatcgcatgttctcactcatagctggaaattgaacaatgagaacacttggacacaggtagggggacatcacacacagggcctgttgtggggtggggggagtggggagggatagcattaggagatatacctaatgtaaatgacgagttaataggtgcagcacaccaacatggcacatgtatacatatataacaaacctgcacgttgcgcacatgtacgctagaacttaaagtataataataaaaaaaaaaagagaaaaacaaccccatctaaaagtgggcaaaggatatgaacaggcacttctcaaaagaagacatttatgcggccaacaaacatgaaaaaaagctcatcatcactgttcattagagaaatgcaaatgaaaaccacaatgagataccatctcacaccagttagaatggcgatcattaaaaagttagggaacaacagatgctggagaggatgtggagaaatagtaatgcttttacactgctggtaggagtgtaaattagttcaaccaatgtggaagacagtgtggtgattcctccaggatctagaacaagaaataccatttgacccagcaatcccattactgggtatatacccaaaggattataaatcattctactataaagacatatgcacacatatgtttattgtggcattattcacaatagcagacttggaaccaacccaaatgtccatcaatgatagaatggataaagaaaatgtgacacatatacatcatggaatactatgcagctataaaaagaatgagtgaaaaaatatgtcctttgcagggacatggatgaaactggaaaccgtcattctcagcaaactaacacaggaacagaaagccaaacaccacatgttctcactcataagtaggagctgaacaacaagaacacacggacacagggagaggaacatcacacactagagcctgttgggggtgtaaggggctaggggagggatagcattaggagaaatacctaatgtagatgatggactgatgggtgcagcaaaccaccatggcaagtgtatacctatgcaacaaacctgcgcattctgcacgtgtatcccagaacttaaagtatgataaaaataattaaataagtagagtttgatcagtagtgggagtggagagtggacctcagagagccctgagcagccccacttctgccgctggtctagttaccatcactcccggggaggagccacagctgctgcagcaggacccagtcaccatcaccgcacccatcagcagggcagagacccagcacccacctgccacccctcccccaccattctcgcacccccgcccctgccactcagcttcaccgacaccaagcccagcaatatggggagcggtgcaaggactggtgagatttttaagaatttcatttttaatttgtactaaaagcttacaaattggtgatttttttcaaaaaagtcagcaaactgcaagcacctgttaataaaggtcttaataaattatcaaataaataaataaaatggaaaaaagaaaggaacattcttcagtgaagtagacagcataaacaaaaagaaatcacaacttctggaaatcaaagacacagagaaatgcaaactgcacttgaaagtctcagcaagagaatcaaataagtagaagaaagaacttcagagctcaaagacaagccttttgaattaacccaatccaacaaaaacaaggaaaaatgaattaaaaaaaatgaacaaggccttcaagaagtttgggactacgttaaacatccaaacctaagaataattggtttattcagaagagaaatataaaagtttggaaaacatctttgagggtataattgaggaaaactttcccagccttgatagagatctagacatccaaatacaagaagctcaaagaacacctgggaaattcattgcaaaaagatcatcacctaggcacatagtcatcaggttatctaaagtcaagacaaaggaagaatcttaagagctatgaggcaaaagcatcaggtaacctataaaggaaaacctatcagattaacagcagatttctcagcagaaactctatgagctagaagggacctgggtcctatctttagcctccttgagcaaaacaataattagccaaaaattttgtatccagtgaaactaaacttcataaatgaaggaaagatacagtcttttcccagtaaacaaatgctgagagaatttcccactacctagccctcactacaagaactgccaaaaggagcatgaaatcttaaaacaaatcctcaaaatagaacctctttaaagtgtaaatctcacaagagttatataacaataacacagtagaaaaaaaacccaagttattcagacaacaaacagcacaatgaatagaatagtaccacacatctcaatactagcattgaatgtaaatgccctaaatgttccacttaagatacagaatggcagaatggataagaattcagcaaacaagtttctgctgtcttaaggagactcacctaacacataaggactcacataaactttaggtaaagtggtggaaaaaagatattccacacaaatgaacaccaaaagtgagcaggagtagctattcttatatcagacaaaacaaactttaaagcaaaagcagtttaaaaagacaaagagggacattatataatgatataagaaatagtccaacaggaaaatatcacaattctaaatatatatgcacctaacactggagctcccaaatttataaagcaattactactagacctaggaaatgagatatatggcaacacaataatagtggaggactttaatactccaccgtcagcactagacaggtcatcaagacagaaactcaacaaatgaacaatggacttaaactatagcctacaacaaatggacttaacagaaatttacagaacattctacccaacaattgcagaatatacatgctattcaccagcacatggaacattctacattctccaagataaaccatatgatagaccacaaagcaagtcacagtaaatttaagaaaactaaaattatattaagtattctctgagaccacagtcgaatacaattggaaatcaactccagaagaaaccctcagaatcatgcaaatacatggaaattaaataacctgctcctgaatgattcttgggtccacaataaaatccagatgaaaatttaaaaaaatttgaactgaatgataatactgacacaacctatcaaaacctctagaatacagcaaaggtgatgctaaaaggaaagttcatagcattaaatgcctacatcaaaaagtctgaaagagcacaaatagacaatctaaggtcacacatcacagaactagagaaacaagaacaatacaaacccaaacccaacagtagaaaagaaataacaaagattggagcagagctacgaaattgaaacaaacaacaacaacaaaaaagataaatgaaacaaaatctcgttctttgaaaggataaataaaattgatagattattagtgagattaaccaagaaaagaatagagaagattcaaataaactgaattaaaaatgaaatgggagatattacaactgatacacagaaatacaaaagattattcagggctactgtgagtgcctttaaacacataaactggaaaacctagagaagatgaataaattcctggaaatatacaaccctcctagattaaaccaggaagatatacaatctctgaatataccaataaaaagcagtgagattgaaatgataatttaaaaattgacaaaaactgtatgtgaccagatggattcacagctgaattgtatcagacttcacagaaggattggtaccaatgctatgacactattccaaaagatagagaaagagggaatcctacctaaatcgttttatgaagccagtatcaccctaatacctaaaccagtgaaggatgtaacaaaaaaagaaaacttcagaccaatatcactgatcaatgcaaaatcaatgcaaaaatcctcaaaaaattatgacaaatccaacagcatatcaaaaagataatccactgtgatcaagtgggtttcataccagggatgcaggaatggattaacatctgcaagtcaacaaatgtgatacactacataaatagaattaaaaacaaaaatcacatgatcatctcaatagtcacagaaaagcgtttgacaaaatccagcatccacttatgattaaaaccctcagcaaaattggccatagcaaaataggacatataataaggtaataaaagccatctatgacaaacccacagccaacattatactgaacggggaaaagttgaaagcattcccctaagaactgaaacataataaggatgcccattttaaccacttctattcaacatagtactggcagtcctagccagagcaatcagacaagagaaagaaataaagggcatccaaattggtaaagaggaagtgaaactttgctgtttgctgatgatatgattgtatacctagaaaatcctaaagacttgtacaaaaagctcctacaaagggtaaataaattcagcaaatttcaggatacaaaattaatgtacgcgaatcagtagctcttctacacaccaacagcaaccaagctaggaatcaaatcaagaactcaacccctttcacaatagctgcaaaaaagtaaaaatacataggaatatatctaaacaaggacgtgaaagaacaacaacaaaacactgctgaaagaaaacatagatgacacacacaaattgaaacacatcccatgctcatgatgaggagagtcaatattgtgaaaatgaccatactgccaaaagcaatctatagattgaatgtaatttccatcaaaataccaccatcgttctccacagaactagaaaaaacaaccctaaaattcatatggaaccaaaaaagagcccacataaccaaagcaggactaagcaaaaagaacaaatctggagggatcacattacctgacttcaaactatactataaggccatagtcatcaaaacagcatggtacttgtatgaaaaagggacagagactaatggaacaaaatagataacccagaaataaagccaaatacttacagccaattgctcttcaacaaagcaaacaaaagcatgtagtggggaaaggacactccattcaacaaatcgtgctgagataattggcaagccacatgcagaagaatgaaactggatcctcacctttcaccttatacaaaaatcaactcaagatagatcaaagacttaaatccaagatctgaaaccagaaagattctagaagataacatcggaaaaacccttgtagacattgacttagacaaagacttcatgaccgggaactcaaaagcaaatacaacaaaaacaaagataaacagatgggacttaattgactaaaaaccttctgcacagcaaaagaaataatcagcaaagtaaaccgacaacccacagagtgggagaaaatcttcacaatctatatatccaacaaagactaatatccagaatctacaaaaaactcaaatcatcaagaaaagaaacaatcccatctaagagtgggctaaggacatgaacagacaattctctaaaaaagatatacaaatggccgacaagcatatggaaaaatgctcaatatcactaatcatcagagaaatgcaaatcaaaaccacaactcaataccacctgcctcctgcaagagtggtcataatgaaaaaaatcaaaaaaataatagatgttgttgtggatgtagtgaaaggggaacacttttatactgtcggtgggaatgcaaactagtacaaccactagggcaaacagtgtggagattccttaaagaactagaagtagatctgctgttcgatccagtaattccacttctaggtatctacacagaggaaaaaagttattatatgaaaaagatacttgcacatgtttatagcagcactatttgcatatttgcaattgcaaaaaaatattagatcagcccaaatgcccatcaatcaacgagtagataaagaaaatgtggtactgtggtatacatatatcccaggggataacactcagccataaaaaggagcaaaataatgacattcacagcaacctggatggaattggagactattttttaagtaaagtaactcagcaataaaaaaccaagcatcatatgttctcactcatatgtgggagctaagctatgaggctgcaaagggataagactaatacatcagattttgaggactcaggggaaagggtggtgggtggtgagggataaaagactacacactgggtacagtgtacactgcttgggtgatgggtgcaccaaaatctcagaaatcactgctaaggaacttattcaggtaaccaaacaccacctgttccccaaaaacctattaaaaaaattttttttagaacaaagaaaaaccaacaacatatttggatatttatatttcaggtgggtttcttatagacagcatatagttgagtcttggtttttaatcttaacagtctcctattttcagttgaaatttttaggccatttctatgtaatgtgaatattgatacggttgctgtttgctttctatttgtcccattcttttctttgttcctggtttcctctttttgactgctcttgaattaattttgtttaatgattccaatttatctcaattttagcttataaacgataaccttttcagtattatttagtgattgcttaggatttatagtacacgtacatatttttcttatttttatttatacataacagatgcacatgttttcagggtacatgtgataatttgatacattcatataatgtataaagatcaaattagggtgtttgggatatacataaccttaaatgtatatatgtacatatacatacacacatataaccttaaatttaaatgtatatagagagacagaaccttaaatatatatatatttgttaaatatatttgtataaataaataatttgttatatatatttatatataaatatgtatttgttatatatatatttaaggttgtgtgtgtatacatatatatgtttaaggctgtatggccatatatgtgtgtgtgtgtatctatatatatatatatttgaggttatgtatattccaattaccctaatttcatctttataatctttaaatatattttataatctttaaaatgtatattaatttgtaaatctaattataaatctttataatttgatctttaacatatacatatattttaatgctaggaacacttgaatcattcttttctagataatttgaatgtacaatagattaatgttaactatagtcaccttagtgaactatcgaacattaggtcttagatcttttatctaactgtatatttgtctttttaatcaaccctcctccacctccccttctcagcctctggtaaccaccaatcttctctctctcttcatgaggagatctatcactttagctcacacatatatgtaagaacaggcaatatttgtctttctgtgcttgacttatttcacctagcgtaacaactcccagtttcatccatgttacttcaaatgacaggattttattctcttttatagttgaataatattccattgtgtaaatattgcagatttgctttatccattcatccattgatggacacttaagttgattccctttttttggctgttgtgaatggtgcttcaaaatacgtgactacaggtatctctttgatagattgatttcctttcttttaaatatatacctactagtggaattgctagatcatacggtaattctatttttaagtttctgaagaaactccctgctgttttccataatggctgtactaataatttacattcccaccaacagtgtaccaggtttccccttcctcaacatctttgtcagcatctgttacttccagtctttttcataaaagcattctaactggggtgagataatacatcactgtggttttgatttgcattttttatgatcagtgatgttgagcttttttttatatatacctcttggtcatttgtatgtcttctttgagaaatgttttagattttttgcccatttttaataagatattttgtggggtctttttgggtgtttgtttgtttgctattgagttttctgagctccttgtgtgttctggttattcatcccttgtcaggtggttactctgtaaatatcttctcctattctgtgggttggttcttcactttgttgattttttcctttggtgtatagaagctttttagcttgatgtgatcccatttgtttatttttgcttttgttgcctgtgcttttgagattttacacaaaatatctttgtccagaaaaatatactagaacatttccctaacgttttcttttagtagtttcatagtttcaggtttagatttaaaacttagatatgatttttaatacattttgattttttatgtggtgagagatagggatctaattccatttttctgcttatggttattcagcttttgaagcaccattttttgaagagactgtcttttccttattgtatgttctaggtaccattgagttgggtataaatgtatggatttatatccagtttccttattctgttccattggtctatgtatctgtttttatgccagtaccatacagattaactatagctgtcttgtatattttaaagttaggtagtatgatgcctgcagctttgttctttttgttcaggattgctttgactattctgggtcttttgcggttccatataattgttttttctattccttttctttgttttctttttgagacagactctcactctgtcactcaggctggagtgcagtggtgccatctcggctcattgcaacctctgcctcctgtgttcaagcaatgctcatgcctcagcctcccagtgtagctgggattacaagcatgcaccaccatgcctggctaatttttgtaattttagtagagtcagggttttatcatgttggccaggctgctctcaaactcctggccccatgcaatcttcccacctctgcctcccaaatgctgggattacaggtgtgagccactgtgctcagcctgttttttctatttctgtgaagaatatccttggtattttgatagagattacattaaatctgtaaattgctttgagtagtattgtaattttagcaatattcagtcttccaatccatgagcttggaatattttttaaatgttttatatcctcttcaatttcttttatcaatgttttaaacgtttccttgtattgatcttttactatttctttggttaaactgtttcctaggtattttatattctttgtagatattgtaaacgggattgctttcttgatttgtttttcagattgctttttgttggcgtatagaaatgctacatttgtatgctggtttttatatgttggtttttgtatcctgcgactttactgaatttgtttattgattccaatgactattttgcagagtctttatgttttccaaatataagattaagtcatctgcgcataaagccaatttgacttcttttgtcctaatttggatgccctttatctctttctcttgcctaattggtcttgccaggactttcagtattgtgttgaaaaaaagtgaaagttttgataatatgatgtatgtcatttattgacttgcatatattagacaattttgcattcttgggatgaatctcacttgacttatttcacctggcatgaatatcatggtgaattatctttttaacatgctgttgaattcagtttgctattatttcattgaggattttgcatttattttcaccagtaatattgacctgtagctttctttttttgtggtgtgtttttctggttttggtatctcagtaatcctggccttataaaataagtttagaagtattccgtcatcttcaatttgtttaaagactttgactagaattggttctgtgtttaatgttcggtagaacatcaggtcctaggctcttctttgatgagagactttttattatgacttcaatcttgttactcattattggtttattgaggtttcctattccttcatggttcaatcttggtaggttatatgtgtcaagaaatgtattcatatcttccaggttttccagtttattggtgtatagttgttcatatgtctctaacgattctttgtatttctgtagttagttgttatgtctcctttttcatttctaattttacttaattgggtctactcttttaatcttagtatagttataggtttgttgattttgtttatcttttccaaaaaccaacttttcgttttatcgacctgttttactttttgtctcaatttcactatttttctgctccaatttttattacttctttccatgtactaatttaggttttggtttattattgctttgtcagttccttaagagccatcattagcttgtttatctgaagtcttcacacctctttgataaagtcatttatggccataaacttctatcatttgttgtatcccatagatttttgtatgttgcatctccatttccatgtggttcaagaatttttataatatcctttttaatttctttatgacccattgatcatttaggaacatactgttgactttttatgtgtttctgcagtttctgaagttcctcttgttattgatttctagtttgagtccactgtggtcagaaaagacacttgttcagatttatgctcttaaatgttttgagtcttgttttgaggcctgatacatggtctatcctggagaatgttccatgtacttatgaaaagaatgtatattctgatacagttgggtgaaatgttatgggtctagtgtgtagtttaactcagatgattatttgttgacttttttgtccactactgaaagtagggtgttgatgtcccctactcttactatactgaagcctgtctttgcttaacattagacttactaatgtttactttgtacacacggatgctcctgtgtggggtgcatagatgtctatacgagtatatcctctatctgaattgatccctttatctttatattctgactttctttgtctctttttacagcattttacttgtagtctattttatcagttgtaagtatagatatttctgctatttttggtttccactttcacagaatggcttcttctatctcttcactttcagtctgtgtgtgtgtttatagtaaggtaggtttcttctagatagtatttagttgtctttgttttctatccagttaatcactctgtgtatttttattagagaattatctccacttatattcagtgttattattgatgaataaaggcttattattgctattttgttgcttattttctggctgttttataactcatttttttcttttcttcctttttttacggtcttcctttgtggttaagtgtttttctctggtagcgtgttttaatttgttgctttttattttaaatctgttttaaatttgttgctttttgttttctcagtttacatattttatattgcctatctcttaatggttgctgtaattattactgttttcgatagattagttttttcatcttcatagtagagttacaagtggattgctcatcacaattacaatattagagtattctaggtttgtctgtgtacttaattttaccagtggatttctacctgtattttttatttctttttgcacattagcgtttttttttttctttcagtctgaagaactccctttggcttttaagacaggtctaatagtggtatattttctcagcttttgttatctaggaaaaactttatttctcactcatatttgaaaaatagctttgctggatacagtattcctagatggcatttttttctttcagtgttggttcttataggatatgtttgcttagagattatttgtaatttttgaattttttcatttttatcatcttgggattctggatattttagtattaatatgaatattatttcagttctgagatacaattaaaattatttgcaaaccagtttgatctctttgcatcttgcttttaagttttgtttagcagatcacagaagtgcttagtttcagtctaatttttccccaatatggacacaaaatgttatgaggactccactcaatgacctgtgaattatgaggcatggttctttccttaactcaggtagttttgtcgggtaaagactcaaagggatcctcttcagatctctggagtgctctgcctatgcagtctttccatttccagtactctgccctataaactcatgctgctttcactttccaggactttcaacaatgaatttcttcaactcagagatacctcaggatcctacctaatatgttgtctcttcaccatgtcctagggaatctctagccagtaagatcaggcaaacttgagcctcaactaattttttttttttttatttctcagagcagtatccttcattggctgatattcaatgtcttaagaattgatgtttgatacattttatttggtttcttactttggttttcattttgctttttattttagttgttttaggcataatggtaagcccagtctctattaatcttgtcctgaagtggatgcttgaaaaatcactggaattgtgtatcaatcttaaactacattttgtctcctagagcagagtttacttatggttattcatttttcaattatgagactcgatttgtcatgtaaggagtgattttcttttttcccaacttttattttaagttcggggtatgtgtacagaatgtgtacgtttgttagttaaatgtgtgccatggtggtttgctgcatagatcatccgatcacctaggtattaagcccaggattcattagctatttttcctgattctttctctcctcccactcctcaccttcaaacaggccccaatgtgtgttgttccccaccatgtgtccatgtgttctcatcattcagttcccacttataagtgagaacatgcagtatttggttttctgttcctgcatcagtttgcatgctggtgaggttgtggagaaaaaggaatgctttgacactgttggtgggagtgtaaattagttcaaaaattggggaaaacagtgtggcagttcctcaaagtgaagacctagaggcagaaatactatttgacccattactgggtatatacccatagaatgtaaggaattattttctaatggttaatctgattactattttaggatgtagccacacaattctgggaatttcatttttattgaaaaccttttgacatgtagtccctaaactggaagttccttttgcacaaagaatttgacacccttctcagacatttttttcttgagagctgtctaagcaccatgcaagaggcttattatatactcaaaagtcacaatatgcctcataattttttttcctcaggaaaaatatttttcaaggtatcagtcttagaagagtcattcagggagaatgatttcctctgtcaattcaatgtatattgaaaagaaaaaaaagagtgtgatataacttgagaagacacaaagtgtaggcaacatttatgtggcaacatggcactgactattcaatctttattgatagctaatgagttttaccggatgtctacttggcttatcatagattattagagttggcttggtttattgtgtccaatcaggatggatttgcaatctaattaatttgttcctcacccctgttgaccttcaagggaataaacagaaggaaattcctagatcattgaatcactgctttcaccactacagagtcattcttctgcatgcagattgaatattaaaaaataaacagcttcacaggtgtttatttagggtgctgtgaaagaaaccaagagaagagctaaggaatttttctgtttatccttttctccaataatttcatggacaggtaaatctttaaaacacctctcaaaaacaccttaatttttttttaaaataatgtgacgaagcagcttttagttatttagcatttctaatcttgcaatctgacttagtggaaaatcactttgttttcttcatctcaggtttcaaaccaaaaatatagccataatgtgttctgcttttgtatagactgcataagataatatttataaaaatcactgtgaaacacagaccactcatcctatatataatatactacgacaataataggtgttgttgctgaattattctattttcaatgtttactatgatggttgaacacaaagcttgagcctattacgtataatttttttataaaatactctaaaagaagaatcaatacatgagaaaaaaattaaactttgacttcaacatagtctgtatggcagtgaggataaaatggctaaaagaaaaaacaagcaatatttgctaacaatagaagaaaatatcctggaatccattttttttcctagcaatagagggtaactctagaagttttttttttcttaccaaaatgccaagaatatacagcagagcaaaaagcatgcaaagcacagaagctgctttcagagtatgtcacagcagctgcattttgaaaagagttgaagaagtaaaaaacctgaaattttagtattacccatctctatatagttatgagttaatcataattctcttaagactgtaacttgaactattatacagagagatttaaaagtctttgaaaataaatatttgcgaacagtgtgattcagaatacaaagaaagatatttattttcctttagcaataatcaactgagtgttaatagtccttggagaggcagaacatttacaaattccttcatagaatattttaaaaataataaaagcaagttccatctacacttagaatataggttcattggccgggtgtggtggctcactcctgtaatcccagcactttgggaggccgaggtgggtggatcacctgaggtcaggagtttgagaccagcctggccaacatggcgaaacccggtatctactgaaaaaaaaaacaaaaattagctgagtgcagtggcaggcgcctgtaatcccagctactcgggaggctgaggcaggaggatcacttaaacacgggaggcagaggttgcaatgagctgagatcgcgccattgtactccagcctgggagacagagcaagactccgtcaaaaaaaaaaaaaaaagaagaagaagaagaagaagaatataggttcattgttaggtagactttataaacgttttttatccctttgctctctgttttaatcataagaattagtgatcctactcctttccacagtgactccttgcacttctctcttgaatataacagtcagtccttgcagggcacttacccagcagtcaggtgatctgttcttcacgagttttatttcacttgaacctctcaataacactgaggtattgatagtactattatctccccatttggcagacttgacactgaggccaacagaggctaagtaatgacttggttcatgcagttgaatagtgggagagtgaggattaaaccacaaaccctgtggttataaacacgatgagataacgctttgttatataaaccgagcctctcactctgtgacctttctcagaccctactccatccataattgttctctccactctcctgaccttctgtcactctctgtccctttgctttctccatctttagtggctccttttgctcagccatatattaaagcttttatgtttttcaaaactgcagtaataccatcgttcttaccctccagctccaactccttcctctgtgccaaggtcctcacagcaatggtcacttggcctccatttccactcttctcatttattttatctcacccaccatgaaactgaaagtgtactcttaaaatagagtaataaatttctgatttctagttttatttcagttcacattctactctaattgtatacaaaatttggcaatttttaccgcaatatcttccctccttttttttttttttatttttagagatacggtgttgttctattgcccagactgtagtgcaatggctcaatcatagctctctgcagcctcaaactcctgggctgaagggatcctcccacctcaactttccaaagtgctgagactacatgcgtgagccactgtgcctgtccaatatctttctttttctttttctttttctttttttttttttttttttttttgagacggagtcttgctctgtcaccaggctgtagtgcagtggtgcaatcttggcttactgaaacctctgtctcccaggttcaaggaattcttctgcctcagcctccagaatagctgggactacaggcatgtaccaccaagcccagctaatttttgtattttaatagagacggggtttcaccatgttggccaggatggtcttgatcttttgacctcgtgatctgcctgcctcagcctcccagagtgctgggattacaggtgtgagccactgctcccggcctggccaatatctttctctaaagtctcttcttcctttcctttttactcctgattttctttctatgtcagttcatttatttttattttttgtcctctctctccccttaagtgtttatgttttaagatttctgaccttttttctctcttctctccttgatctatcaagaatcattaatccacaaacaagaagagtcctaaatttctatctctagccctgactctcacctcagcatgggattcgtattacaaacagtacagtggacatcagcacctaaatgctatgtgggcttctcaaatatttccaaaaccaaacacatgatctcccactgccctcagaaatgtccctttcttcttcattttctatgtatatgagaatgaccattcagttatctaagcataaaactcaagacccttctcagttagttaaaatatttaaagtgtttagaaaagaccctgcacattataaacactcaataattcttagttaacactaaaattgcctttactagttaacagtactatttgccattgacttctcactcttcctcacttactatatccaactgaactcccgtcatgacaattcaatccctactaagtctctggacttttgatttctccttcctttttcactgccactgctttagttctttcaggctgtccattttcaaacaccagagctggtctccctgacttcagattctaaccattcccattacattttctcactgcctacagagttatcttgctaaaactcaagtggggtcaggcactctctgtgataagttcatgtaattgtaccacgtaaggcctttcccaatctaaacacaagctaccctgccagtcatgccacttggcatttagccgatgacaccttccatgctgtgctccagttagaactgcttctcaaccctaagactgaccatgccccgacatattatactctttttatacctatgctctatgccttctctttctgcctggaaaactcctacttcaatcttaaatcctattaaaacttttaactgttaatcttgattttaaacattactctttccctacctagctccctgtacacttccatccctaccccagtcaggcagaacagggtactgtctcctcagggtttctattttgtaaatttgtagaagcccatttttataacacaaaatcttaaataattgtttccacaatatcatatttttacaatattatgtttattgtccagtaattatgtaatagctaatcataactccaacgtatcttgaaggaggagcttcaggtttgtttatatttttattttcagaacgattcttatatttgacacacaacaaattcctaaaaactgcttgtaaagtgaatgaagtaaaacaattcttacatttcactttctcagccaacctactctttgattataattatggtagatactgcttttataacccacttcattcctcacatcctttacatttataccccaaatataaattggtaggaattctctaaaccattcagtgtctcattttccttacctgtaaaatgctgaaactactttataaggttgtcatgggatttataccatttatatacaaaaaacaattagaatataacaggtatctgattagcatctaatacaattaactattactatgattactcttgtattcgaatgttcctttttcctctgatacatttgtgtgcaatgctccctatgtttggatgataatgttttcttagttttcccacataaaagggagagatcagtgaatccctttataagataaaagacatatgtaattatattagtctattctcacagtgctataaagaaatacctgagactgggtaatttataaaggagagaggtttaattgacccacagttctgcatggctgggaggcctcaggagacttacaatcatggcagaaggcaaaggagaagcaggcaccttcctcacagggtggcaggacagagtaagtgcaaagagaggaaatgccagacccttgtaaaatcatcagatctcatgagactcactcactatcacgaggacagcatgggcaaaactgccccatgatccaattacctccgccttgtcctgtccttgacgtgtggggattatggggattacaattcaaggtgagattttgggtggggtcacagccaaaccgtatcaataattaagccctaaaatgctctttggttagaaatgatgagatttgttcttagggtagtaagaattattcttatgttattattttgttattataagagcaagaatttttagtccaattattacagtctccttttaaacaaacactttataagtggcttttgattatcgcaccattgtaaagggataccaaaggaaacctgaggataaggagtgagatgcttgctcttattttcacactggcagctaaacagacaaactactttctgctttttaagtgctcgccagttaaagctgcatgtgagcactattggtttttatttgtttgtttgttttacttcactgtttttttcaaagtactttatgctcattaacctattttctatgtggatattccaattaaatattagaacaaaaagttgtttacttttaagtttcttttaggagaatgaaagaaactcccaaatttctgcattagaatcgaattaaaatatagaaaagaaatttatctgtgagttcccccagctctgcaagatacgaatcatctctcatcactcactttttcaggcctcaggatcaaactagtgccagaggaggaccaggtgactttttttctgagggagagaagtaatgggagccattgtcattcctctcactttttaaatggattgagctgccatgggagctatttgtcaacaaaaacagaccagaactcattagttaaatacagatcatgtgagattcagggagcagcatatggaggggtataatgacaaacttaaaaacagccatttggttacaaattgtcttaatattaatagttacattctaccatttagttactacttcctaaatactgctatttacccataatacgtaataaaaaactaaaagatcgtgaaaggaggagagaaacaacgaatatactaaagttgttatggaaaatcttcgtagacttacagatattacacacatatgcatgtggcaaaaatactttttttcctttctgtccacattgtttcaaaactttcaggtgaatttttaattcattcattcatatttttttcttctatttacaaaacaaacatacattttgcagccattaagttccagggcctccggcaggcaaaagaaactaaaggccaataaaattgtcctcgagaagcttgtatttcttatgcagtgattttcaaagcatgttccttagagcaactacatgagacgtaccatgggaatttgttaataatgcaggcacctggattgactccaaattataatttccgtgcatgagcttccaaagtctttatgtttaacaagcaacctagttaattcttttgcttttaaaaaatttgcacactgatctaactgctttgctccactaagtgtggtctgagaaaggacaacggtatctacatttctcattccaattatatccaaattagagtcttttaacttgtcatccagtggttcacatgtacttcaaagtctaaagagtaataatctagtctatatgatttctggagccaaccatataatgatattatgtggaatggttggtgtgtgctgtgggagacacacctaaaaagttctccagaacttgaatcctaccatcacatattattctatttttaacatttctcaggtgaatctgtttcaactactatattttacttgggtttcttatttttgtttgtttatttctattggcactgaaaatttaagggatagtgatatgtagtttaagatgggttatcgtctggatatttgcctggtggaggggcatatgaacaatgaatatgaattgatacaaatacaccacaagtcagagttagcacaacatatcttcattcatccacttctttattttactcagcaaatatttatttatttattattttatttatttatttatttatttattttttgagatggagtctcgctctgttgcccaggctggagtgcagtggcgccatcttggctcattgcaagctccgcctcccgggttcacgccattctcctgcctcagcctccagagtagctgggactacaggcgcccgccaccacgcccggctaatgttttttttaacagatttttggtagagaaggggtttcaacgtgttagccagtatggtctctatctcctgacctcgtgatccgcccacctctacctcccaaagtgctggaattacaagcatgagccactgcacccagcctcagcacatatttattaggcttcttctttgagccagggatttagatagtatttaaaataataataaaagcaaatatttactaaccacttttactacgtattgatgagtctccttaattgtcacataagttactgcatttaactgtcacaaccctgtaatggagggacagtgattactctcgctttacaagtaaggaagctgaagcccagagaggtagaataacttgctcagagtcaccgagctagaatggattttattgggaacttaaatacgtatctctttcatcagagcccttccttttaacctctatgctatcctaatgctcagatttctgggactcagatcaccgaagcccttaatcaaacaaacctgtgaaaaatttatggtgaaaatattacatatgaggcaaacaggagggtcaatggaagtatggaaggaagcaagaattcacgaggagacagagaaggccagaagatgcttccagggcacatggacagagaaggacagtggtatcctagccttatggagcagaatgcacaacggcagaaagcatgagagaacacactgggtgtagggaacttaacatttcttggttttgctggagggtgagttttgagacaggggagaaattggaaatgatggacagaaagtaaaggatcagatattgaagagaatgatatgtcctgctaagtatctgacatttctcttataggtgatacaagtctattgaataattttgaactgataaattattatattttgcttcagataaattaattgtcaaacatagtgaaatcttttaaataacaataactccaaatggtttgttactgcaaattgtagtcttctgagggaacatataaaagaaacagctgtgtttctgagagagtttgtaggcattctgaccccaaggaaagggtaagcatgacatgttttcttataccagaggtcaagaccttcccagtggtttgtttttgacctggaaaattttgtgtgcacatttttttccctcagtcagtgacattattcttgcagagcaggtgcattcgaaaaattattttgtgttaatcttttataagcatgaatgatttttaagccatcatttaaaaaattattcctaggttttttggtagttttgggttctaaagactgcatattgttaggcacaataattaattgtgacgcactctacccacaaagaaatgtatacacccatcagcaagtctccattgggccatcaagtcgtctgcctgcctcagcctcccaaagtgctgggattacaggggtgaaacaccacacccagcagcctcaggaaactttcagtcacggcagaaggcgacaggagagcaagctcaccttacatggcccatacaggaggaagactaagggaaaaaaatgtgcacacaaaattttccaggtcaaaaacaaaccactgggaaggtcttgaccgctagtataagaagtaattttactagaagtaatgctttaataacaacaccaactccaagtactcaacaacatgatacttataaacctttacctgattaagccatccaattagccgttcaaagactgtgtaaatacagacatagatgatgtctgggggattacaatttgacatgagatttgggcagggacacaggtccaaaccatatcaccaggtgatcacagaaaaccaaaaaagagtaggaatatttaatgtagacatggtcatctgtgggtaaagtccttcttcatatcctatttatttaaccctcctcagagttagcagggttagtcacacactcatatgtacctttttctagaaaaaaataaatatttctaaaagtttgaattaagtgaactaaattatagttgactaatttttaaaaatagagtaaacagtcacaatttggagcacaaaccaagaggaaagaagaaggactttacccacagctgaccatgtctgcattaaacattcctactcttttttggttttctgtgatcacctggtgatatggtttgggcctgtatccctgcccaaatctcatgtcaaattgtaatccccagcattggaggtggggcctggtgggaggtgactggatcttgggggtggatttccccctcagtgttgctcttgtaacagtgagtgtgtgccgtgagatttggttgtttaaaagtgtgtaacacctctcccctcactctcttcctcctgtatgggccatgtaagatgagcttgctctcctgtcgccttctgccatgattgaaagtttcctgaggctgccgggtgtggtgtttcacccctgtaatcccagcactttgggaggctgaggcaggcagatgacttgaggtcacaagtttgagaccagcctggccaacatgatgaagctccgtctctactaaaaatacaaaaattagccgggcattgtggtgggtgcctgtcatcccagctactcaggaggctgaggcaggagaatcacttgaacccgggaagcagaggttgcagtgagccgagatcaggccactgcactccagcctgggcgacagagcctagctcaaaacaaaaaaaaaaaaaaaaaaaaagttttcctgagttctccccagccatgcttcctgtacatcctgcagaaccatgagccaatcaaatctcttttctttataaattacccagtctcgggtatgtctttatagcaatgccagaatgaactaatacacctggcgaatggaattaagttacacgatgatgcaatttaactaaatttcaagggatacgaaccctgctcacattgatacgatttctggtatctactacttgtagcatatgaaacaaataatcattggcttcttactctgtggttagcctggcattaacccaggagaggagggttctttgtcattctccctaactatgagatattgcttatgaggtagcataaagcagagatctccagcttagtgattttttttatgacccaaatcaggataccaacttaagcatttcagctcttatgcattaacaatctgtattctatgtacatttttcatagtaacagcaattttgtggtgtttccttattcttcccttttgtatcacagtggagcccattcactctgtttttccacacagtatatctttctaggtcacacccttgctgcctcaagaattttaacaagagttataaatctgcagtgtccagatacctggaaatctcttgctgaccttatccttcatcattttagcatgagaatttggtatgactttgagtaatgttgtgatttaagaaagcatattacagaaataggtggtgccctttgtaacacaacaaaaatgccatgagcccacaggtcctctgtcaataggccattctgttggttgttggttttccagctgtagagatgtcattaagatgcttctacttccttttctcaaattaaactgtttttctatcttatcttttttttttttttttttttttgcaataagtaacctgtgttttattggaaagaacataggaaatcaataaaatttaggtttgaattcaagctttggcacctacctgctaagtgattctcggattcccaatctgtaaaatggataaaacaaagccagtttcaaaagattgctatacattttaaattatgcaatacaagtaaaatgctaacattttatctgccatagagttggtcctcataaatatctagtgtcattgctattgtaattattttttttttgacagggcctcactgtgttgcccaggctagggtgcagtggtgtgatcttggctcactgcaacttctgcctcacgggttcaagtgagtttcgtgccacagcctcccaagtagttggggtttcaggcacccaccaccactgctggctattttttgtattttgagtaaagacaggttttgccatgttggcgaggctgatctcaaacttctggcctcaagtgctccacccgcctcagcctcccaaattgctgggattacaggcgtgagccaccacacttggcctaatattttgaacacattttactcttggctattgatgcacggagtgttagagctgaaatagttcttaattttggtctctcctactgtagatcaggaaggcaagagatagagaggacaaatgagctattcaaagagcagagggtcacaaatagaactagcgttctcctcaagccatcttgatccatcagtttcaattcatgctataatctattgtatagtatctgctctatgttgatatttccttactggtagcagtattcctcttcccacctcatagtgtatacttgtatatcattttgaagttgcagctaataatcaaggactctgtctaatgtttcatgtgaaacccttggacttcatgatattttgaatgttaaataatttcatcattttaatagtttatctcagcaatggcgtatgcaaaattagctggatgaagagtgttatctgaccaaggccaaaatctgtagcccagagacatagtacattttccctggcccagtggtgctggaatatatttaagcctttacagcaaactaaaacaattcatttaaggaattatgagagccaaactatttttttagagcctctgactgatacttcatgtgctaatagagaaaaatattatgatgtcaatgtttttctctttaaaatataatgtaatgtggcatgactgatatagccaatcttgaatattagaaatgatgcatcatcacctaattcatcaaaatcaatctcgaaaaggtcagtcttacttgaaaaataagttgattggccttaaatgaacatactacgatctcaaaattagagagagacctcatggttttgctaagttgttttttcaaagtaccctcatcacaaaatttaggcatgcaaatgtcaacaatttgtgtagttacgcatttaaaaagtcttcttcaatggaaacacacaaagtttcataactttcagtggctgatgcctaccgtaaataactaccacagattacatagtaaactcttcattactcagggattgaccagtcagttggtaaattaactgcgttctagattttttaattctctctcctcattgcatgtctgctggttacatcagtactcactagcaagtcaaacatcatgaaggaaaaaagctaaagaatatcccattgattttaaaaattatggagaaaacgtttaaaaattggctttcatttgaaactttgagtctctgtacacataatatatcaaagctccttctctttactatttatacaaggcactgtcttgcggtcagttatatattttaacaggtgaagagcagaggcagtaattttttaaaaaatttttctaatttttaatttgtataggtatatagtaggtatatatatttatggggtacatgagatattttgatacaggcatgcaatgtgtaatcatcacatcagggtaaatgagataatcattgcctcaagtatttatcctttctttgtgttacagacattcaattatactcttttagttatttttaaatgtatactacatttttgttgactgtaatcactctgtgtattaggccgtcctcacactgctataaacaaatacctgagactgagtaatttataaataaaagagctgtaattgactcacgcttctgcaggctgtacaggaagcatagcatcttctggggaggtctcaggaaacttacaatcattgtagaaggtgaaggggaagtaagatgcctcacatggccagagaaggagaaacagagagagaagggagaggtgccacacacttttaaaagaccagatctttttttttaattttattattattatactttaagttttagggtacatgtgcacaatgtgcgggtttgttacatatgtatacatgtgccatgttggtgtgctgcacccactaactcgtcatttaacattaggtatatcacctaatgctaaccagatcttacaagagctctatcatgagaaaagcactggaaggatggtgctaaacaattagaaactgcccccatgattcaatcacctcccacctggtgccccacctccagcattggggattacatttcaacatgagattttggggagaacacagatccaaaccatatcaacctgttatactatcaaatattagatcttattcattctatctaattatatttaggtactcgttaaccattctcagtttcccctgcatctctcactaccactacccttcccaatgtctgataactatcattctattctctatctccataggttcaattgttttaatttttagatcccacaaataagtgacagcatgcagtttgcctttctattcccagcttatttcactcaacacaatgtcctccagttccatctatgttgttgcaaatgacaggatctcattctttttatagatgaatagtactccattgtgtactgtaccagattttctttatccattcatctgttgatggatactttggtagatcccaaatcttggctattgtgaatagtgctgcaataaatacagagtgcagatatctcttcagtatactgatgtcctttcttttgggtacataccgagcaatgggattgctggattatatagtagttctatttttagtttcctgaggaatattctaggataaaaagatttttgttttctttcagcactttaaatatgacatgccattctctcctggactgatatattgatatattgtatatagtctgctgccagatatattggaatgcctttgtgtgttattttttctcttgctacttttaaggttctttctttatttctgacctttgtgagtttgcttattaaatatcttgaggtaatcttatttgggttaaatatcagcgttctataaatttcctgtacttgaatgttgatatctttctctaactttggaaagttctatcttattatttctttgaataaactttctacttctacccagctgaattctgccctgtgttgctttccactgtgaccaggaagcactgagttctaatgcaaagtcccgcaatcactgcactcaccctctctcaagtgcactgattttctttctgtgccatgtggtccagaccaggggacggcggagggatggtatcagtaattcaagactgtctttcctaccctcttccatgcttcttttcttgatattatgttaaaaccaggtattgtaatcactcatccaagttttggttcttctgaaggtgctttcttgtgtgaatagttgttcactttggtgttgctgttgtggagtcgatcactggagggttctatttggccatgttgctctgcagaggcagtaattttgatttatcaattctattagtttataggggttttgtttgattccttttactaatcttatgagtaattttctcaaacttgtgtttgcataagagagccattttgtgtgtgctgaaaggctgtgtgtgtgtgtctgtgtgtgtgtgtgtgtgtgtgtgtgttgcttaatgtcaaatagattcaaactattggtaattttgaattgaccagctgttttcatgtaaaagcaatgataatcaacattttggtgagatagggaggtaacttaagattctagtaattaaccaaggtgtaagcaacttaaaattatttccatctgtaaaattatcatttcaacaaattatattgttttagagcaatgaccatgtcagcaatgacaatgacaatgtagcaatgacaaggacaaagttaattctggttacaaaagaaataattcttgtttagtgaatcaaagatctccactcaaaatcacaccatttgaattcttgcagactttgaagcttaaatagattcttagccttcacaacccctgggcatttttaataagaagcatagtgtgattctctgcttgggtaaggaaataaaacagaaatttttctcgaaagggccataaggtatattacatccaattagtcctatcttgactctgtgaagttgtcccaaataagagtgggtgataactgtttgtaatttccaaccacagaattcaccttagtttgtactttgaatagttaatgcttggcagtagcagcttactttaatataggggacatctggaaaataccttgtaaacgatgaaaccaaaacattcaattgtccaaaaatattatggagtgaagaacacaaccacatataattaacttaaatgtacagaggcattatatttgttaaataatttattaataatattatttttcagttcttttcattctttgcaggaagttattatacatcaattttaattattttagttttatattttctgttgtctcctgtgattatttaaatcagaattaccatttcctaaacataattgcagattgaaacatgtgactatatttcttattttaattttttgttttataagcttcatctggtacatattaaccatgaaccttactctcattcaattcagctcatggtcagataccacaattgaagtagtatcactcctataatatttttaccatttattattgaaagcagttgagaattaatgattttaacagaagtgacgtttgtatacagttccattaaacaattaagataatacttgatccacagaatacattggaaactttataaattagaaatacgctgaataaatagacaactcatgctgagaataaatgttgaataaatcaaacaaatgtttcatcatacttggatccttccaatcagttatctaatttctacaaatgtattttacatttatccttttaagtccatttataatgtcatcgctctttgccaacaatactaaatgttaattaaattttgaatattttaatcactattacattgtgattgaaaaaaacagtgtattcaatctaattttaatgtgtctcaacctcagaaaatatttttctctggtcatattttcatgagtaaaaattatttccaattatattttaaccgtgtctttttcattattttaaacagtaaaattttaatatgtttactcccttcttgttttatgagtctaaatgctgtaaaataacaatagccaatgtgaattacgcaagcattttaaaatgtaaaaaaaagcaccttgatatgaaaagaaatgctcagttgtactctcaagacaagaatttaataataaatactatgcttaatgaagacagtttctaaaattaaaaaaccccaaagtgatacataacacagatattagtaacaaaaagagaggctagattacttcttgctgattctcacctacaccagcctccaataaatttctttcttttgaaactgcttttcacctgcttatctaaatgtgacttctatctctctatccctcagtcctccatttgtcatgaattgttctctcacctactgttcccacagttcactctctgccctgaaaattgtaatagtttctgtgttcataacttagtcttactctccaatgatttctcatattttatgattactgttacattaaatgttttatttccttgaccacattgtaaagtcatggaggactggaagcatgttttatgcttttggattgtccattatattggatacagtgccacggtcaacagcgtattgtatatgtacatttatatgctcccaacatatgtaaccctcttcccatcatcagcttcttttcccttgtttcaatgtttctcaactgagtagctccagcatgcctaccagcggccaaatcaaattatcagtattttccccaatctaataaatcagtaagtcttatctagtattccttctcaatatatcttgaatttatcactatctcccattgacactatcgtaggtcaagccattgttaatctataacttagcttgcactggccttctaactggtgtaactcttcaaaattgcttctttcaaaacacttgcttattcagtagccagagtgatgtttctaaaatgtagacataagctaatttcctgcttaaaatcaccagttgttttttatttggctcatgataaagtccaagctaagcagggtagcataaaagaactattatgatctggggtctgtccactttgccacctcatgccaaatagctcccttcatcactctcaatgtcttgttataccaaattatatcaaatacctttccattttacataacagtgcactttctacatgtatctcctcttcttcatatatgtattctcctacactttaccagcatgtattgatcttagatctttttacaaaaggtttagatgatttctcctccactcttgaaagaaatattttatgttctccaaatttgcttgcataatttctttaaatttgcatgtataattcattatgtttctccctattttaacagttgtcatttactgatgttataagtattcttctgtttgcccagtcatctgtaagtaaattacatgcagagggctatgttttcccatagtttaatcccaaatacttagtaaaaatatgtttttaaaatatttttaaatgagtgatgggtggtttggtagatggatggttaaaagaacaattttttaatacataataaatatgagttgaaccatgagaaatgaaatttatagagcactggtacaataatgtgtaattttcctttaaaatgtctttaaaattcatttaataactcattaattttattatgatacaaataataataatgatgaagttgggcagcaaaggtaataaggagttacattattgagcacttaatgtatgctagatagtgtgctatgcccatttatattactattatacacgccactcttaattgcttattttcttaccaagcttgagaaaagagagtcaatcagactgtagtgagccagctccagtttctgttttactaccaaaacgatctactttatagcctttcatttcttgtctttatctatgcaatggagacaatatttgctgactttataacaatatagttatgggaactgaggcaagatgttgaaaattattttaaactcagactacagaaatttgatataagccattccttttctaaattgtaatttatgttccttcaatatcagaaaataatattgccttcattcatatcaaaagtactccgtatctgaatctttcattccagccgatctgatatactcactatattccaaatagttcatgatggcatgtgtgaagaaaatagtacattgtgcatttctgcactcttcttcctagttttaaccgacaatttagttctcatggttcccttttctgacacctttatctttatagagttttttaaagtgacatttgaacatatgtaagttacctcaaatcttttttggaataggctagggagaaaatgagacagaaattgtgaaaataaaatgccagtcataagataactgaaaataaatgaagattggctcacctatcaggttataataatttttttaaccacaacattacgattccgtaagtccgtaggaagaattatttcaaaagaaatttccaaaagggcaaaaagggcagagtaggaaacttgaaaattcatctcctcataaaaacaacacaaaagctaggcaaacaacaacaaaaatcttgtctaatttgacttttctagaattctgaaaactaactaagatgctggagaaattgggagaccatttgttgaagaaatacctactgaatcttggtaagaacaatgagctttgaggtatttacacttaccctggttccatcccatactcctcatcttagtgatggtagtcatgaaaatgtactgtatttctagtacaggtaatcagtgctggagggagcaaaacagacctcgctcacaaataattgttttagcccacctggtagctccctgaaagacctgcttaaagtcaagctaaaagtgcttgccttaatgtctcataacatggaactctcccagtgctgaggttgctaccccaaggatgtttgtcaaaaatgttcacaggcaaatataatagtcactgtttcctggggaagtgaataaaagttggggcaaaaaaaaatagattaattaaaagcttaggatgaaaggctggagattgaaatgctttggggaataaaggctttgaaaatttcacatattctgggaatccagagggccacacgtaggtacagggcagtgcaaatcctcaggaaaaaccgaaaaaggcattaatctctcgccactgactaaccttcggtctctgcgctggcaagaagtgaatgctagggcagggatggtacacggcctcactagagtttaacacacagaagcccatctcaaaattctgggagatgtttttggttccaggcaagtatagaaatctctgtccaatcactagctgactactaacctcacagaaaagagatgttattgaccacacatgacaaagaatacagactttatgatattaattcagaaaagtcactaaacaaacaatcaccataacaaacagaacatgaaactctggagaagagaaaaacctgaattccatgcttgctacattataattctcaaaatgtccagttttcaacaacaaacacaacaggcattagacgtgccaacaaacaagaaggtatattccatgcacaggaaaagaagccattcatataaactgcctctgattaacctgagacattggtcttagcagacaaatcctttaaatcagctattttaagtgtgttcaatgaactaaagaaaatcttgcccaaggaactgaagaaaataatgataacaatgtatcaccaaatagagagtatcaataaagagaaagaaatttaagaaatgaatcaagtagaaattctgaagctaaaaagtacacatttaaggtactaaaaaaaaaaactatcaaccaagaaaataaggcattccataataaataaaaacagttttcactaatagacttgtcctaaaagaaatgctaaagggagtacttcagactgaaactaatggacactagacagctacttgaatccacacaaagaaattaagaacatggttaatagtaaataaataggcattataaaagtattatgtaaaagtcattataaatgcatttattgttttaactcctctattttgctatctgatttaaaagacaatagcaagaacaataattataaatctacgctagtggacacacaatataaaaagacaatttatggcagtaacataaagtttcagttaggatgaataagctctagagatgtagcatacagcacagtgactatagttaggaattatgtattgtacacctgaaaattggtaagagagtagatctcaaatgttctcataaccaaaaaaatgataagcatgtgaggtaatgaagatgttagcctgatttaaccatcttacaatatgtacatatatcagaacatcatgttatacaccgtgtatgcatacatatacaatttttgtcagttatacttgtaaaagctgagaaaataaaattaaataaagaattcgagttcagaaataaatcctagtacttatgttcaattgatttcaaccaaagtgctgagaccactcagtaaagaaagaatagtcttttcaacaaacagtgctgagacaatataatatcgaaaagaaaaacaaggagtttgggccgctatctctcactacatagaaaaactaactcataatggatcaaacgcctaaatgtaagacctaaaactacaaaactctgaaaagaaaatatacgtgcaaatttcatatatttgaattaggtagtggtttcttaagtatgactccaaaagcacaagcagcaaaagaaaaaaatggtaaactaaatttaatcaaaattaaactttttatatattgaaatatattatcaaggaagtaaaaaaagacccatgaaatgagaaataacgtttgcaaataatatatctcataagggtttaatatccagaatatgtaaagaccataaaattcaacaccgataagataaacaacacaattgaaaaatcagcaagtgatctggataagcgtttctccaaagaggatatacaaatgaacagcaagcacttgaaaagatgctcagcatcattagtcattagagaaatgcaaatcaaaaccacagtgagataccacttcatacccactagaatggctaagaaaaatggaaaacaggccgggcgtggtggctcacacctataatcctagcactttgggatgccaaggcaggcagatcacttgaggtcaggagttcgagaccagcctagccaaaatggcgaaaccccgtctctactcaaaatacaaaaattagccggacgcggtggcaggcacctgtaatcccagctactcaggaggcttaggcaggagaatcacttgaacctgggaggcggaggttgcagtgggctgagatcttgcctctgcactacagcctgggtgacagagggagactccatctcaaaaaaaaaaaaaaaaaggaaaatattaagtgttggtgggcacgtgagagaactgcacccctgatccatcattattgggagtataaaatgatgcagccactgtggaaaacaattaggcagttccaaaacctaaacgtaaagttattatgtgacacagtaataccactcccagataaagctcaggcgactgaaaatagttgttcataagaaaactcatgtttagagcagcattattcacagtagccaaaaggtggaaataatccaaatggccatcagctgatgaatgggtaaacaatatgtggtatgttcatgtaatggaatattattcagccacaaaaagcaacacagtactagcacacgctacaatatccatgaactctgaaaaattatcctaaatgaaagatgccagacacaaaggtcacatattgtacgattccattattgtgaaatgtccagaataaatagacaaattcatggagacataaagcagattagtggttgcaagtggcaggagctgagaggaattggtagtgacggattaatggattttcttccaagagtgatgaaaatgttctacaattagattgttgtgataattagacaccattgtgattttactaaagaccactgaattttacatttttaaatcgttaaaatggtaaattttatccctgtttttaaacatttacaaaaaaatttccaatacaagttttcaatatacatactaatatggaaaacaatgagaatatatttcatggcttgttgtgcattctatgtgaggtttgtttgatgaaaacacctttcttttcaactattggtctgaaactcacaatcatgttaaatcaggttttcccaatatccatttgtagagtctagtacagtacatttttactaggatataagcattttgaggatacaaatatttcttgtttagttaactgtttgcaactagcttattgacttacaaataatgagcatatcaataagtagttgtttaataaatttattaatttcctggcttgggggaaggaaggtaacatattatcattggcagtgctttgtcgaattcttgccttcagatttgaatacaaaaaatatgatttattgtcatagctacaagtaggatagagcagctaatatgttaggttcacagagatcagtcaattgataaatatgatattatactaagacttgaattaacttaatcttcagaaacccgtggaagctttactttatgtaatatgattattattatcatctttgatttcagtattaaatgctttgtggctccttagagtcctagaacaatgtaaaagaaggtagagaggaggtccactttcatataagtgagaatttttagctgtcagatagttgacattaatgaacttcacatttatctcttcctaacagcaatttttaagcatatatctgttaatctaggtctttcattatttccatacataagcccattgcaaaattcaccaaatgacacagtagactgtcccttcaataatattattagaaaaaaagtgcactgttgggttcattttttgtagtttcttgtagcaaccttagttaaactaaagctggaactaaacaactaaagtttacttgcttaatttaaccttcagtctatgatattctcatgtctgatctttattttagaaatacatattataggcccagggcgacggctcatgcctagaatcccaccacttagggaggctgaggcaggtggatcatgaggtcaggagttcaagagcagcctggccaatatgctgaaacccagtctctactaaaaatacaaaaattagccaggcgtggtggcacacagcttgtaatcccagctactagggaggctgaggcaggagaattgcttgaccctgggagatggaggttgcagtgagccaagatcacaccactgcactccagcctgggtgacagagcaagactctgtctcaaaaaacgaaagaaaaacatatcatacctgctatgtacaatttcttttcacaatataataggtttggattttaccttttattatatttctttcctcaaatattattattttatttcagcactccttttgaattgcccactctgctttaacaataatgctgttgtttatttgtatggtgcctgaaataaaccatgctattggtctaccttggctgccatttcttattcctcatccaacctgttttctttcaaagaggctagctcttattaaagaaagatgacaccaactagtaatgttttgactactttagactcctgaaaactgtgttttccatcattctcttgaacttccataaagcttgtcctggttttaatctaattttcataagttacagagctatgcaactcaacacaagaagcaatactaataaaacttactccaaagactaccactggaaatgttttgttgttttgaatcttactatgtcattcttggaaaaagtggctttcatttccaatgagggtagatttcactttgtttgaaaaagtggtagaagaaaacgacaggcgaagaaccacttaaacaggtcactttgaaggagttctttatacttgaaattctattctctcaagttcataatttttataattgaaatataaaatattttattttcatagtaaacctcaaaaataaaattaatatctcatgagcaaactatctgaaaatgttcatgtattgctagttgtccaagagtagtttgaagatgactcattgcaacactggtagaacgggcatcatttgtctgccacccagttctagaatgaagagccgactgcattttgttgcacccaagacactatgaggaaggatttgctcacaattttgtaattgaattcattaaaatttttactctcataaatatttgctatcatttagagtttcctgtcatataaaaaatgtagagttttgaagatacaccaaaaatgtgtcatattggactcactcttaaaaattaattaatcatgcagcatgtaaaacatatagaaattataaaggatgtaaaaatgaaaacaaaaaatggaaattataaagaatgcaatagtcatatctactacctagcttaataaataatatattgccaaaggtcaaaatatttgttgtttctttcttcctgaacatcagcctctgcagtaaacttgtttctgtatatgactgtcttaaatttccctgcatgtttattgcatacatacggatccttaaacaacatccgggggttggagggtgaggcagggcatatagtctataatttgcagaaaatatatatgagtcaaggatactattgtgtggagaccagcatgagcaaaagaatagacccagagtcattgaggtactattatgtgtagggtctggtaaacatgggtcactgaaggcacaccatgattataggttctgaatagcttttttttcttcttcttcttctttcaagagacaaggtcttgctctgtcactcaggctggagtgcaatggcaccatcatagcctgggttcaagtgatgctcctacctcagctccctcagtagctaggactacaggtgcatacccccacatcttgctatttttttgtttttttctagagattgggtcttctgtgttgtccaggtctgtcttgaactcctggcctcaagtgatcctctaatttaaacccccaaaagtgctgggatcagaggcataagccactggacctggtttacaggtcctaaatatctaagagcaatgccaacgtaagtccaatgctacacatcctctctctccaaatggctcaaaatggaggcaaaggagtgggactccaagacagaagatgtgagtgaattagaggaggaggagaaacaaaagaaacaaatatggggatatcggcttatagccatgtctacatttacaacaaccctgctcttttacctgcaacaaaataatctaaaacagcttattaaaaatagattagttttgttttattactatggcattaaccagtatgtgttcacaaatgaaggcagattgggaatagacttcgcttcactttcaaggttcctttcctcaattaagtctaaaagaggagaactatttccccactccctcatccccatgaaaaacaaaagaaaagaaaaaattctgtatctttaatttttttctaccaaagctgatacctgaaaatcttttacagctgcatctgctatttcctgctcagccctttcttaactctcttagatatgagctaaaagaaaatatgcccagataccaccttaccctagcagcatattctctacctgccttacccactctgtgtgccaacccacttgttctgatgcctgaggtagaaatagtagagttttggctgcaaaatgctttcttcttgcatttattatagatgacaaaaatattttggagttaaatggtgagatggagggatttttttttaggtcttatatttgactaaagatttgtgtttcttgctttgtgaaaatttaatattttaactgtattccagcagccctatgaaagtaggtaaggtagatgtactaaacccattaacatgataaggcaaccagaggctcagtggattgctaagatggtgaattgcttttttactaggtgaaattatatttttatggaaaggacagaaggagcagagtttgttttggtcttttgcttcgttttttgtaaatgtgcatgtgttagcaaaaacacaaagcagcaagaaaccaaggatgtggtaaattattcactttatgacttcaaagagcttctcttttatgactagcagcctcacagatcaatagataacgggtgtaaataagaatcatagaatttaggagttggacaaggctttgaaggttattcaggacaacccctcataaggagttatgttggtccaatattgcttggaaaagatgggctaggccagaccttccagtctagtctgagtttgagtttgtgtgagaagtttgactggaactaggtacaagcctactttttctttgatttacttacagagtaggaaataagaagggcaaagattgccaaagaactaagaatgctttgagggttaaaatttctgctgcgttcgcactggggcactcttgtacctgcgattgctctgcggggcttaggagatttcccatattgcccagtatgggcagaattgtccacaacctgccacaagaactaacccagactctgcgagaacattcccccacaatgggtagttgatatcatagaactttctttctcactgtaggaaaccctaatttgtcagcctttcttctactgctttatattgaaagcaaggctagcttttaatcataaagggacaaaaaaaaaaaaaaaaaaaaaaaaaaaggcacactcctagttaacacccagcttctactgctcttttagaagtccctttgtttcatggagaccagaaaaaaccatttacatttccaactctttgtcttttttattttattttattttatttttcactcggtctcccaaactagactgcagtggcgcgatctcggttcactgcaacctccgcctcctggattcaagcgcttctcatgcctcagcctcctgagtcgctgggattacaggcacctgccaccacgcccggctaatttttgtattttgagtacagacggggtttcgccatgttggcaaggctggtcttgaactcctgacctcaaagtgatcctcccacctcaacctcccaaagtgcagggattacagacgtgagctaccgtgcccggcctctttgtcttatttttgcagcctgaaacaaagaaaaagtcaacaatctttttttttatttttttattttttgcaagccagcccttcaaatacttaaatgaattatctctatttcacaaccattcacagccttggtcttcatctttgttttttgtttttcttgtccccaaatcccgacacatcttctcccatgatacaactccctattctgttgagtgccttcagcggaacactctccagtgtgtcactgccattataaaacgcagatctcttagtgaccccaggtgaatctcaatccttccccctgaatagcacgtttcaactaggaatccattcgtgtctatcttggtaatcctatacagtcagtcattccgctgagggttccacctaagggtgaccccaaacgaagggagggaggaaggagaaagaaaacaaaggtgaaagaaagaacaaatacagaaatataaggaagaaagaaaaagataaaaagaaagaagagggaggaacagaaggaaagatttaaaaagaagaagaagaagaatgcatctactttagcatattttcttaataaatcacgcaagttttaaagagtccccctcttttatcttctaaggtctcacaaactatttgataaacattacagtaggtatttcttttttttttttttttgcctatataatatgcactctcttttttctctaataccaatatcctaatttcctaatgaatccaggctccgtcactcctaggacaagtgctttgtgtggcagagctgtgtccaatgctagctttgtagacacatggtatgctgttctgaacaatcagatcactttatttctccaaccatgacaactggttcagagatggacatctgacctattcagagccattcagaattaacctcagtttttattgagaaaaccagaatagattctatttcaacacgatttggaagaaatcttgggaacattagtgacctcaacaggaaaaaaaaaaaaaaaaaagcaaacgtggaagaaaaataagctgatggcggggacgggaaggagccaggagataaaaacagcttcctgatagctggaaatagacaaagcaagctgcggttagttctactggagacgttttcccttactgatcttttttgtttaagcctcttgtagctgagtttcttttatttgcaacagaaagagacatgtctaatatttattttcccaaaatatgcatcaaatttcacttctttccaaattgattatttccagtttaaaacatgaggatgatgcgtgcacatctttagtactctcaatgtttccaacccttatcttcaatgtaatttactaacaattatttaaagctccctctctcactattgtaagctacacgaaggcagaaagcatcacttattttaatgacccttatagtttagtgcagtgccaggcacttagttaacacaccatataaatgtctagatagatagatatatagaggtaggtgataaagaaatttatatatatatatacactatatatatagtatatataaagaaatacatatataatatatgcatgtgatagaacgaaagaaaggataggtagatttatcgataggtataaagcccgtgggctgtgacttatgcctgtaattctagcaatttgggcggccgaggcaggtggatcactttagcccaggagtttgagaccaccatggacaacgtgacaaaaccctgtttctataaaatatacgaaaattagctgggtgtggtggcatatgcctgtagtcccagcactcgggaggatgagacggaaggatcccttgagcctggaacttcgagactgcagtgagcggagactgtgccactgcattccaacctgggcaacacagtgaaatcctgtctcaaattgatagatagaataatagaaataattaaatgaacgttatgtcaacttccctatggtctatacatcttcagcctttaatagcgtttgctttgggagctcattcacaacatcttttattattctgacaggtttcattggatcacgttctcctgaatgattttccccttctccctttatcctgggttatcagtttttctaactaaagaatgttcattttatgctaggaagctgagctcagagagatgctcctcaaatttttaatcttagaaaattttctgggaaacctatggacaaggtgctcacctcgcttgcaagaacaagcttagtatattcacaatcatacatttcattgtctctctgagggtcaatgtttcttgctgaagctcataatggatttgaaaatccttgtaatgcctaactcccctttaaacaattaaccagagtctcttggttcccttggagactattctaagacttaaaattgtttttcttctcccctgcccacactgcagctaaaagctatgaattaccacaataaacaatattgagaaatgtcaaaaatcatcatttcatcccatggaaaataatcaaagagcaaagatagagattcccttcctatttatgcacttgtttaagaagtgtctgacctctgtgggatcttctgggaaaactttgatattttgactattcgttattaaaaattcatagatagagatgaaaatgaatcatttactttttttcaatcataccaaaattggccaaatggcttttgcagctgacagtttccagttattctttgtgatggaaaagggctatcaatttatgaaggaggaggcatgatagtgacatccataataaaatttaagcaataatctgtacacaaataacatatttatcatccctcatgcaaaagctaagccatttgcaatttgtaaacttacattaagttcaaaataaagaaattttaaaaatgcatgctagttaaataaaatgcacagtgtttataattgggaaacataatatcaataatgatgatggtgatgattatagagagaaattatataggtttaaaagtatgccaggccctctaataagtgctttatgtaaattgattcatttactccttccaaagatcatttgaggcaggtaatcagctaggaaaaatattctacagagtatgcagtaggcacagcaagtgccaagggtctgaggtgagaatgagcacagcatgttgaagaagctaaaagacagagtagataatatgtcttttacataacaatattttatatcaattttcatttcctttctagtacaagattatttagaatattaaaattttcagttaaaattgttttttttcccttggctattcttttctgttgttttttttaaatattttgtttccataatgtggactcaattttcagtttcatataatttgtttttattttaattttgaaataatatattaaaatttaaaatattatttcatgagtgttggaaaaactgtattgttgttttaagattacagttctgtgtgtgtgtgtgtgtgtgtgtgtgtgtgtgtgtgtgtgtatgtgtgtgcatggctaccaaatcaaatttttagtagtttgaattttgctattcctctttgagtctaatgtcaaataaattttgtatgaagtatctttaaggctctaacatttaaggatcagtaaatttgtctttgtatttccatgagcttaattttgtatattttgatgctgcattttaaaaataagttacactcaagttttgttttttattgtattttaagttccaggatacatgtgtagaatgtgcaggtttgttacataggtaaacatgttccatggtgatttgctgtacctatcaacccatcacctaggtattaagcccagcatgcattaactatttttcctgatgctttccttccccctgcacactgctcccacccctcaactggccccagtgtgtgttgttcttctccctgtgtctacgtgttcacattgttcagctctcacttataagtgagaacacgcagtgtttgattttctgttcctgtgctagtttgctgaggataatggcttccagctccatccatgtccctgcaaaggacatgatctcattcctttttatggctgcatagtattccatggtgtatatgtaccacattttctttatccagtctattattgatgggcatttgggttgactccatgtctttgctactgtgaatagtgctgcaatgaatatatgcatgcatgtatctttataatagaacaatttatatttcattgggtatatacccagtaatgggattgctgggtcaaatggtatttctggttctaggtctttgaggaaacaccacactgtcttccacaatggttaaactaatttacattcccaccaacactgtaaaagcgttcctattggtccacaacctccccagcatctgttgtttcttgactttttaataatcactattttgactgttgtgagatggtatctcactgtggtttttatttgcatttctctaatgatcaatgatgttgagcttttcttcatatgtttgttggctgtgtaaatgtcttcttttgagaagtgtctgttcatgtccttcgtccactttttaatggggttgttttttcctcgtaaatttgtttaagtttctcatagattctggatattaggcctttgtcagatggagagattgcaaaaattttctcccattctgtaggttgtctgttcagactgatgatagtttcttttgctgtgcagaagctctttagtttaattagatcccttttgtcaattttttgcttttgtttcaattgttaccaaaaaagagcccatatagccaacataaccctaagcaaaaagaacaaagctgggggcatcatgctacctgacttcaaactatactacaaggctacagtaaccaaaacagcttagtactggtacaaaaacagacacacagaccaatgaaacagaatagaggactcagaaataagattgcatgtctataaccatctgatcttccacaaatctgacaaaaacaagcaatggggaaaggattccctgtttaataaatggtgctgggagaactggctagccatatgcagaaaattgaatctggacctcttccttacaccttatacaaaaattaactcaagatggattaaagacttaatgtaaaatcccaaactataaaaacctagaggaaaacctaggcaataccattcaggacatagacaagggcaaaaatttcatgttgatgctgtgtttttttatgtatataaggttttatgattttacttttaccattgtaaaatatgattagcttgtctcattcatcttttttttctggtattacaatgggtttcacagtgttggttcaatgcctgccttttgttaaaatttgcccaatttacttttaccatcattttattattatactttatattgtcgaatttttaactttctcactttcacacaacatatagctagatatgggattgttgttcatttgttttctcttctttctttttttttcttcttttctctccctaatgttaaagcctctgatttataaggaaatataactcatgtttattatgcctacaaacatacttagtatttcttaggttgagattcccagcaagtggagcctgtggcaaaggctggtgtgcttctgctccattagagtgtgatcccagggagaagtagtgagatcaagtacagcaaagcagggaagaagggagagccaatagaaaatgtgccatggggctgagcattacaaggtaaagcagatgtttgaccttcaggatctcttcccccagaagctatatgactgtggctcagaaccgtgtgcccaaaggagacagagaggataatttatctacacacatctgttgcccatcactcaaaagtctggctgatagggggttaattctgccccaccacccacccctacacacacatatttcggttggacataggtgggcactgacgtagattctttgcttcctgtacttatatgtgaatagcaaagtgttgagaactggaagcatgagtgagtgacatgcaaggaactgacattgaagtaagattctgtgagggtgaggttgcatttgtagaaagtggttatagtccacttagcaatggtcatcacagaggtggctgagggaccagtagatggttctgaaaaggtaagtggatgctacctaggtttgtttagtcttctttctagcagggtttctgattgggtttcatttattttattctcttgtactgaattgtcttttcctatttttcttttttgttttaagcattattcatcataggcctaatagttgcccacatatatttaatgtgtatgtttatattataatttttgaaggataatttgaattattatccatttagaaaatgaccataacatactttcacatttcttgtgctctaccttcttcacctcaactagtcaccctttatatgctctgggtttcatattgaaaatatatttgaaatattcctggatcattacacataactctgtaacatatttattttttaaattctggagaaatctatttttgagctcactagtttcctttataagtctatccatttctcaattcaacccactcatagagttttttaattacttttttcaactaaaaattgaatgtttaaatctaactcttttaaaatgaccactgcttaacataaactgggaagagataagggagtcatggcccatctgttccagtaatcatccagatggacaaccaggtggcctctgccttgcttacaatcattaactgtgaacctggaggactgctacaaccaaccttagcagaagatctgaggatacaaaagtttagggcaccagtttcttatgttcttttttttctttataattcttttaatcttctctttatgtttcagggattcctcaaaatttgcaattggttgatggcactcttcatctttctgatgttcatttagaagtggtatgtgtgcgtgtgtatgtgtgtgtagtgtgtatgtagtcattcttaccagtagtgcacacctccccccccaattctctcctctatcctactttgttcttttgatttttttcatttcaagggattttggaaagtagaagagtaaaattgtatagtcaatctacaccctttgatacaatctccagtgcactaattaattttacatttttatcattgttagtttttattgaaacacgcatgccaaaagaaaaaaaatccacccaagaataattgaattggtgtatctgagtttggtagataatcctttaaatcttaaattgtgttaatctcagcatttgcagagctattgcctgctatcctgtagtgaacccagtttctaaatcagagcaatccttaattaaaatgggacattaatcaacagcaaactatttgcatctaccattattctaaattgtgtgacttgacaagatccacgttattgcctaagataaacattaaatatataaacttcataaggcagaagctgtttatcttagtcttatctagaaaagacattacaaataaggattcattaacttattcattttatatatatgtatgtttttcacgttatagatacgtatattattctttgccaattatattgtaattatatgctttaggattaaataacagttgtaattttttgtcacacacatgcctgcatgtgtaggcactttatgcatatgaacacatttatatttcttatttatacatcaagattatgcaaaaaaatgagaaaaaataaaaatatgaaaatgcttaattcagttatttgtgcaacctaaatataaaattagagcatgcctccaggatctaatgggagtcttaagggtccattagatggcacaattggtttaaaattataatatctctcaaatttttaaaattaaaatttgccttcaatgtaaagcaatggtaacaacaaactgttagaataacatatggcactaaccaaattgattctaaatggccacctgtccctaatatctatgatttcctccacagataattactgggaacctgatgctcagtactgtattaggcattaaaaggatgaagatgactaagggaacaaaataacagcttagaataattctctcctttttagagtttttccctaactttgtcaaagtataattaaaaaataaaaatgtctatattttcagcatacaatgtgatgttttaatatacatcttcattgattaccacagttgtgcttattaacatatccatcacctcacaggtttacatattttttttgtggtgagaacatttaagaatactctctgagtaaatgttaagtatacggtacagtataattaatgataggtatggtctattggatttccaaaactaattcattctgcataactgcaactttatgtcattttaccaatgtctcctcttttccctcactctcaagacactggcaatcatcatttttctctctgtttctatgagtttaagtttttaagattgtatatgtgagagtatgctgtatttgtctttctgtccctagcttatttcctttaacataatgttttctatggtcatccatgttgttgcaaatgacagaatgtccttttttttgtttgtttgtttttgtttttgttttgagacggagtctggctctgtcgcccaggctggagtgcggtggcgccatctctgctcactgcaagctccgcctcccgggttcccgccattctcctgcctcagcctcccgagtagctgggactacaggcgcccgccaccacgcccggctaattttttgtattttttgatagagacggggtttcaccgtgttagccaggatggtttcgatctcctgacctcgtgatccccccgcctcggcctcccaaagtgctgggatcacaggcgtgagccaccgcgcccagccagaatttcctctttttaaaaaaagaaaaatggccgggcgcggtggctcacgcctttgatcccaacactttgggaagtcgaggcagggggatcacgaggtcaggagatggagaccatcctggctaacacggtgaaaccccgtctctactaaaaatacaaaaaattagccgggcgtggtggcgggcgcctgtagtcccagctactcgggaggctgaggcaggagaatggctgatcccgggaggcggagcttgcagtgagctgagatcctgcaactgcactccagcctgggcgacacagcaagactctgtctcaaaaaaaaaaaaaaaaaaagaaaaaaaagaaaaatattcctgtgtgggtgtgtgggggtgtgtgggggtgtgtgtttttgtgtctgtgtattttctttgtctattcatctgtctatgaaaacagttgattccgtatcttggccattgtgaataatgctgcagtgaacacaggaatgcagatatctcttcaacatactgattttatttcctttgaatgtatacacaatattgggattgctggattatatgataattatttttaattttttaagaacctccatactgtttttataatagctgtaacaatttacaatcccaccaagaatgtacacgggtttccattttttcacaccctcaccaacactgattatcttttgtctttttgataatagccattctagccattctaacaggtgtgaggttattgtggttttaatttgcatttccctgatgattagtaatgttcagctttttttttttcatgtacctattggccacttatatgtcttcttttgagaactgtctcttccgatcctttgcccattttttaattaggttatttgtttttgctgttgagatctttgaattccttatatgttttggatattaatctctcattgtatatatggcttgcaaacaatttctcccatgtaggttgcctcttcattatgctaattatttcctttgttatacagaagctttttagttgatgcaatcccatttgtctatttttgattttgttgcctttgctttggggatcatatccaaaaattatttgcccagaccaatgtcaaaaggggttttttcctatgttgtctttcaataattttatagtttcagatgttacattgaagtctttaatctattttgggttgatttatgtagacagtgtgagataagggtacaatttcattcttctgcatttagataagcagttttcccaacatctttattgaaaagactttccccattgcatgttcttgtcatctttgtcgaagatctgttgacaataaatgtgtggatttatttctgggctctctatacaattccattgggctgtatgtctatttttatgccagtatcatgttgtttttattactatagctttgtagtatatttcaacatctggtagtatgatgccttcatcattgttcttgtcaggattacttttgactgtttggaacttttgtggtttcatatgctttaggatttcttttgtatttctgtaaataataccattggatttttatggggcttgcattgattctgtatttgttttgaatttttaacaatatagattcttccaatatataaacatagatttttttgtttatttgtgtcttcttcaatttctttcatcaatattttaaagtttaactgtacagatcttttatctcctttgctcaatctattcctaaatctgttttaaatgatactgtgaatgggattgcttccctattttcttttttgggtgtttcattgttagtgtatagaaatgccacagatttttatatgtttgttttgtatcctgcagttatacactgaagttgcttattagttctaacactttttcaatagagcctttaaagtttttccatatatacagtcatgccatctgcaaagagacaatttaactttttcagtcaagattgtaatggatatcctccagactgttcagttgtttccttacagaaatcacagttttaccctcagtaatctcaatacaattacaaagacaaataaaaggatcagtatgtctttgattttgttggaaatacattaactcagcttttactcagtttagcatagtggtaagatgtacaggttttgacattagacagatccaaattccaattctgcttcctcgaatcgcgtgctgatgaatttaggcatgttacttaacctctctgagaatctttcctttctttttttttttaatttggtgagtgagcataataatcacaataatcgaataggctatttttcaggtctatctatatatatatgtatacgtatataatatttatatgtatgtataaaacatttagcgtaaaagcattcaattgattttaatctccttacctgtaagtgtttattttggtgtgtattaacacattgtgtgtatgtttatatagtgtctgcatttaaataaaatagatttaaacttaataacctggaatgctagatttatatcatcacaatttattaggttaaaatgtgggtgctctaaaacaaacaaacacaatgcaacccctcaggctcatgaaagtaaaatgagaaatacattatgtggtgataagagctaatacttcatgcaaatgtgacattacacatctctttgtgtttaggactatgcttgtcagctatgcaaatgctagccattatttcttaacacactctggtccttaaatagcaccaagaggaatgttctatatttcactcatttagtacattattgtattgtaatttttaaataaaactaaaaagaactagaccacataaccatctttgatcaatgttcagaacaaatatatggcagagaattattaaacagtacctcaagcatgctctttccagagggcaatggattatttagtaccatgtcaaatcacataaactaattcaaaaatgataaattacaatgaaaatgcatgctgatgttttgtccctgaattctaataatgggtgtaaaacagtgttaactgtcattgatcagacacatttattggcatgctaacctaacaattaccatagtattgactatcaaacagccatatgattatagtatatgatgtactatatagtatatgattatagaaaagatatagcatatgggttcatttactctaggaataccaattataaatataagtaagtgtagaatactaatttgttaattaaataaatatcattttaattcacaacagttgacactctggttctccttgactccctgagttttaaataagaaaatgtattaactaacttagaattttctcaaatttatttatcattgcacttagccttcacctaataaaaatgtttatttggctttaggcgtgaaatttcccagatagtcaaaaacaaatctgccaaatcaatgccaataatcttctaagtattttgaatattaatatttatgaaggacaaaaggttacttttgtaatgttgcaattaaatgtctattttctcttcataaatagaaattaatgaatcaatgtttatgcaactgactgcttgccaattaaacacttatcttaggaattcataaacgtcctttctcttcaaagagtcagcaatagaaaattctttcttttttctcttttttataacctttcttctacctacttttttcttattctccctgcctatttcttgtcattctctttgttctatactcttttttctttgctctacatcctcctccacgtcccatgcagtgtatggtgttaactcatacaaagcagtgcatgtagagactatgttattaaaaccccaggggtttggtctaggttccattgctcactgcacagaaagccaatcactgagacaatgagtgttgcctgggaagagagatgggagccaaagctcaaatctatccctctcacccaagcaacattgggggtttatatatcagggaaggaatttagctatgtacagaaagcaatcatgacaaatgagggttctggcatctgtctggattcggtgatcaggtgagtttctgttccttccttgcctgaaggttaatttccctagggaggaactcagaagtgagtttcaagttttaagaccagaaggggcaatttctatatttatttaaaaaaaaaaaagtaaacatgagctctacggagcatttgggcttgtttcagcagtaggtgagggcgtggctgaggcctggcagggaagcgatgttcacaatgcctgatcaccttagtttaaaacatttagaagctgagaggaaatttcctggtcaataatctaggcacctcaaaaaagtttccattatttttttttcaaatacacagataatttcttggccaaatttcttggcaatgacactgaggcaagaccagaaatgaatggcttgaaagaatgagaacagcaaagaagaattgtccagttgttcaaatgagagaatttcagcccacagttgaggtaatgatagcagatctggaaaagacagggacgatagaggaaactataaagaagagggacactgtagaattcagcaataggttgaagaaaagacagaaatgagtcacagattggaaatggaataaatgcacattgatgccttccttccccactgttttttttaaaaagcacatatatcacctgatggttatctgaacgagagcccgactgaagaggctgacaatcagactaagccaagcagacaagtaaaatagctatagggaacagtcctagaaacaggttttacagtttagcatagatatgtcttttttcttaaaagaaacaatcttggcttatattttattcataaaagctattctttactctgttgccttgagtgattttgcctatgtgtagatgtgagtacagcagctttaaattcacctgtgcccttgaaacagcagcctgtagtacattcaacatcgttgcactgactgctgctattctgccttctttgtgagccaattatgaatctatcttcagaaaattgtgctccagtgctattactgaattaacactttgcttaagtgtgttaattcacagacacccacatgtgtgcctacatacaacctcagagaaaatgtgtaaataagtttaagagtagcaaaaaggcatgctttttatgaaaagcatttaaagtgtctaaaattttctatttatcctgttaagagagaagggtgcagggatttattaatattgaatgaaatgatgtatattgaatagaaaatatattttctttttttttgagacagagtctcagtctgtcacccaggctggagtgcagtggtgtgatctcagctcactgcatcctccatctcctgggttcaagcaattctcctacctcagcctcccaagtagctgggtttacaggtgcccaccaccatacccagctaatttttgcatttttaggagagatggggtttcaccctgttggccaggctggtctcgaacttctaacctcaggtgatccacccacttcagcctcccaaagtgctgggattacaggcttgagccactgcgcccagccagattatattttctttaagatagaaatagtaggcataatcttcctgatcttcctgattttgtcttccatgttaaagaacatttattgtctgtctaaaatttaatgttcatgtgtacatggaatttaaagacaaaagaatacattccgaagaaaaacttaacttgtatttccaagtcctatctttacatcagaacaccctgtagagctttaaaagttctaaaacctgaattccaccttgagaagttatgtttttaaaatccccactggtcaattgcatgcatagccaaagtggaggatccctgtattagggcctgcctgtcgctaggcgcagggggtggcagcagggcacagtggaggtgggtgtgtggtggaaatcacttccaaacttacctagctctaagatgggctgttagagggcagttccttctaaactttaaatctgaaatcaactgttcagtttatgattctgttactgtataaccctgaccttgaatttatctgggtcacctttgctttgagaaaacagcctgtctagaagagcagggattttgtaatcagagatttgaactgaagtcttggctctggccatttactactgagatacttaggtaaattactgaatctcttgtaacatctgtttcctcactctataaagtagagtgattaaaaatatactcaacagttccaaggctgttcaagttcaatgaaagataatctgtgtaggattgaacacacaggaagtgctcagtgtgcgttaatttctttctcctttactgaatggtagcttttttatactcatttgtgctccttataaaataggcaaagttaagggaaagtgattaaaatcacatgagcctgttctctatttggctgtatctctgtaaagagtgagaagaaggttggctgttttaatttttaagacagaaaaatgattttttgattttgttttgatagagtcttgctctgttttcctggctggagtgcagtggtgcaatcatagctcagtataaccttgaactcctggattcaaatgatcctcctgccttagcttccctagtcgcttggactacaggcacacaataccatacccagataacttttttaaaattttttttcagaaataaggaatctgcccaggctggtctcaaactcctgacctcaagcaatcctcctgcctcaacctcccaaagtgctgggactacaggtgtaactaccaaaaacggcagggaaatgatttttttaaacacacatagcaaaatgtttttgtcttaatatgtgatgcccaacttaaaatagttacctttaagagctgagaggttattccaaagatgctgcactgaaaaaaacattcatagccacacgtatgaaattgtcttccagaatttagggtacgtgaagcaggatggaaatgcaatcgcaaggtcctagggatacaaacctgggacaaacaagcaagtttcctgactctatagaatttacctttcagaggtagacagatgttgatcaagtgctcctacagaaaactaggacatgtaaaataactaaggatgggaggggagcaaatgtagaaaatggtaaaccatttcgaaggtaatgagggttgtccggggaaagagatgatgacaccctggactaggtttgggtgctggagtcaacttatgtaaattatttaggagggagagccaacaggatttgcatatcatggggatttctgcatgtattattttagaggtgaaatcaatgggacttgaaagagaagcttatatgtgatatatctgacttgagcaaccagatgaaccatgctgctagtcaataaaattggcaggattaaataaatctcttatatgaggtagaagaccacatcttgaatacattgagtttgagatgcctttggaccatccaagatgaaatgtcggataagcagcaggagcgatgccttggtcccacagacaagagagtgagaagcagttatacgtgggtcatggtataaatcatatgatggccagtgaagccatgagtgtgggaggtcatattcagtgaaagctcagagtgagaagagtgcctttacacaagtttttattaaggacttcctgtgatagcattgactgctgatcacattggtgtttgcataaaatagcataatctaatccacaaattctctttcttagaagttgtttagaagtaaaagcaaagctgctcttcaataaatgtctcttgcacatactcagcaatcctagaagagaagccaaaagatacaatcagtatgtaaaggtacgatcagtgtgtaaagatacagtcagtgtgtaaagataggtcagtgcttagaatgatcgaggggaagtcccagatgaaaaatgttgaaggttgtctggccatgtcagtttcaaacccaaatgaatcctgagatttttatgccctatagaaatagttactcattaagattttatcaaaatagtctccttgaaaaaataattctcatgtttgtcagctgcagtgtgtaatctaaaatttaattagagattttaaatatctcttgaatctctgatagcagttttcaagacatttgaggcttattagctcagcccattttactgcagggaagaatgagatagcaatggtgaactttttttttttttttaatgttaggcaactccttttattccataatgagaaaacacctgctttttaattaaaattctatttctgtatacctttgtttgagtagttgaatcctaaatattcaggggcagtgagtccatttaaaactcataacaagtaaaacttcttaaatttaattgtacccttcaggttcaaaagtgctttggtaatttgggttctaaacagaatgtgggaagcaattaagggaggctgctattgtgaatcatgcatcacactcagaatcgaaagacgtgggttttcattcaccctgtgctacacacaggatatgtttatgagctgagctctgtggaagcagagacatttcttaacctcccaatctccacatctaccttataaagatttggtaggttttgttgtttctgttgttgttgaagttttaaagtttatggtgaaatatatgtcagacattcaggtaagaataaaatattataaaaagtattataataaacattaggtttctttaagctaacattaggaagtaattacttcagtttattttttaaggaattaaatgctataaacacaattgagatcctttttctacctttctcccatatcatttccttccctcctcctccactatacatacaattaggaattcagtgcacataaaaatatttttttttagactgaaggactcctagatccttatctatgactatagagaaacagatcagagagtgtgctaaatctataggtgctggccctgtatatgtcaaaaggataataatttctataaatgtattctgtacttttgttacataattatgtattgataagtatatgtaattttttgcactatgtgttaacgtttatcgaaatagcactacgtgtacattacactacatgtaacattgaacctcttgcttttttactcaatatttttttgagttttctctatgttggtaaaggttactaattcattccaagttctacatcatattattccatttacaaatgtagcataatatagtcttccatattcctgctgatggatgttagattgtttataatgttaaattgttcattataaataatgaagtaatgagcattactgctcttgaacatgccttgtgttcatatgtgagagttttatacacaggatatttctttcttgctgtagactaaaattgttcacttttactatcacactgctatattgttttccaaagtggttgtacaaatttacacttccaatagcagtgtatgagagtcttatttttccatatttctgcaaatatctagtttttccttttttgtatgtgtgcctgaatttatctcagactttcatagctaaatttttggggccacctctactgtcactactaacatctccatgaatgccaccatctccctgattctttccatgcgagcattgtatataggtgcaatggaatgggccaagtgctatttgtaatcatggcagctgtcgtctaatatataactctatataatcaaaataacatgagtaaaatctttaatctgtcttattcattcattatatgttagttaaatgttggcactaagaataattataattctgatttaataattaaaaagataaaagaattatataattttttatgagaacacaccagattcaccatgaacttcaaagagggatacataaaattctgcccttgtgtggatcaaatacatgacatctaacctcaccggaaaactggaaaattagtcaaaatagcaaataattatgtagcttcttccatcccctctttgacattccctaatttcacataattctagaattaaaaggaatacagtaacaaccttgcctaagtttcttatttaaaattcaggaagaatattctcaaattatgaatcctaaagaggtgaaatgccttgataaagtcacataacaacagattttcacctttaacttctttttcctgatttttggcagcctgagaccctgcagtgcagtgttctgccaaaacacgtgggcctgttgccctcaagaacagcccaagccatcaagatttccctgactcacttgtttactctaacatctcacctcctttttctgtaatatttcaggactttcctccttgctaaccaatctaataagctaatgagccagcactggcagaggtttaatgttctatccattctcaataatattgcccaagagggaaatttttcagccagtttctgttgaagcctctcaaaatattactctacaactatcaacctaatcttctcaaatgtaggcagaaaaacaaaaatcacttcagtcttttctattttaatttactgaggtacactaaagaaaacttctctatcattatccacctcataaaggcctgagacaatcacactcatcacttaaattcagacataagcatggcacgctaatgaaactaaggcaaatatgaaggtaacagtttatttttaatgcctattaaatattgttaaattaaaatgaaacatttaagaaaatatatgtgacattcaaatgaacaccaaatgattcatttcacactagtcaatattaaattaactccatattacatgaaaatgttaaatactactgaaataagcagcaaaagaaaattatactgtaacctcacaaacacatcatggttggaaatttgttattcaaaaaagattaagactaattttgtaaaactgttttaaagtcaattatttttaaaaagaattacgagaaaatatcatcacatcagtggttccattatatgttttaaattaatgaactaatgaaacccactaaaatgtaggcaggtgtaaacaaattgctgtttgtataacgcaatacttagtaaagattatttaagtagtatgctaaaatctaaacaatacgtagagtctataaaggataacttttagaattacgtttcaaaattaaagttgaaataataaactgaagaaattgctaacctaatcaattctgagtttgcaatatacaacacgggattggtcacctgatatcaatatgtaagttgtttcaaagtgcaaacttgattttaaaaagtttctttggtcttcatattaaagacatatttaagtatcacagataaattactcaagttatcagttaaattgctcaaagagtaacaccataattactatacaataatattttgattattttgacctctataatcatgctgaagagatatttataggttcttgattaatgggcaattttttgatttagattaattctatgataaacttaaggttatcaagtcttattttttcttcaataatttaacattcacacacagacacacacacttgagtccacgcttgagtgcccactctacaccgtgctgggactcagaaataagaaatcctcggccgggcgcggtggctcacgcctgtaatcccagcactttggggcgctgaggcgggtggatcgtgaggtcaggagatcgagaccatcctggctaacgcggtgaaaccccgtctctactaaaaacacaaaacattagccggacgtggtggcgggcacctgtaatccaagctactcaggaggctgaggcaggaggatggcgtgaacccgggaggcggagcttgcagtgagctgcactccagcctgggcgacagagccagactccgtctcaaaaaacaaaaaaaaagaaaaaaagaaaatccttaaaaaaatcagagattaacggggatgacagacaaactaggacacagtgttgcctgctatgcatgggaacgttagcagaacactctgggaggcccagaggaacagtgtatattggatttggggtggcatcactttctcaggggagtgttgtgtggattgagtcttcagggactagtacttgccagctagacaaattggtgcatactggggctggagaagcagcccatgggaccacaggaaaagcagcagcagctggtgcactgcactctggaaactatactacccaaggtcagtcatgagatgagcttgatgaagtgagagagaagtgtctagaggaagggtcagtactaaatcgcaaaggcctcacatcatgatgagtgactgcagcttgatgaacagatagagaagtctgcaaaaaaaggtcaacagagaaatggcgttatcagattgattttccagaaagctcctactagttgcctcattgttgttgaatatttcctacaattggaaacattaagggcacataaggagaggctttgtgatgatggcccaaggctttacctgggattgaccatagaaggaagggtcagaggctatgctatatttatggctaacagccttgtatatctttttttttagatggagtcttgctcttatagccaaggctggaatgcagtggtgccatcttggctcactgcaacctctgcctccggggttcaagcgattctcctgcctcagccttccaagtagctgggattacaggcacccatcaccaagcctggctaatttctgtgttcttagtagagacagggtttcactatattggccaggctgatcgtgaactcctgaccttaagtgatcagcccaccttgaactcccaaagtcctgggattacaggcatgatccaccgtgcctggccaccctgtatatcttaaactagaacaataaagtgaaggatgtaacttttttttgtttggttatttcttccttgtaagcttggacacaaactaaaatggctcatgagtacagctggaagttaactcaagttagaggtctgcaaattatggcccctggactacacctagtccactatcttattctgtaaatagagttttgtcggaaacaacccagtcacattaaaaccaaagcttattcttctatgaattgtctgtggctgattttgtacaacagcagaaaatcacaaaagagaccataaggcatgcaaagaagaaaatacagtctagccccatatagataaagcttgccaacccttcatttaagagatcactcagtgcagatcgtgtattttttcccacatatttccatcttttttgctctttattgtttcttacaccttagatgcacctggaatcattttctctctgtctacagttcatctcttagaatgactttagtgaaagttgtcacaaagacccctctcaacattgttgctctgaaaaagtccgtttttatcagcattcctgaaatgttctctagattataatcattctcttttagtgcattaaagagattattccactattgactgtctgactttgttgctgttgagaagttagccatcagtcaaattcttgctcctttgagggtgatattttgttgctgttcttcacctgtggcctttcttaagatttttttctcagtctttttttcccccagcagtttcaatgtaacatatttagttgcagatttctttttaattatcttgcatgggatttgtgagcttcttgaatctgcagattactgtctttcagatctagaaaattgtcaatcacaatcttttcagatatatcagctgtcctccagtctctcctctccatctgggactcggattacatttcctaaatcttgtgttggtgtcattcatggttagtaatctctctcatgtatagtccatcatgggtcttttaaaattaaactcaagataattgtttgcaagctatcttctcagatacaaagtctgtctttagctgtcttcagtttgttgttaagtctgctcacagagatcttaatttctatgatatatttttccagaagattttttaaaccttctatgtctgtttctatggttccctgtcctctgcagatatcttttagttggtccttcatttatttacacctttcagtgtagttgttttataatcagtatctaattacttattaataaatatctgatgtctttaccttttgctgtggttccgttttccatttctgtccttttctacttgttctcatagtctagcaccttgttgtcatttttgacatgatgaatattctttttgaaaaaaaaaatttagaactaattgacaaacatttttcaaagagaatgttcattgctgcatcaagttcaagacgtggtacagaaaatacatgactaattctaccgaggttctaccacttccattcaccctttgcctgagggcaaactctttagggtctcagtttatcaagaaggagtcttattagacttccaattttaggtgaattctgcattagattttgattccattcccagaaggcctctgctaggaaatcaaataccttcagggaaaaatccgcttttgtaccaagataaatttccaagttttcattattccttcttttcaggcctcaaaatgtcttattgtcttgttgtctgtgtgatgcttttaagaaattattttgtaatatttttatcagcttttttagttgttttcaacaggccagaatgtccctgtaagcagaccctcccattactataaacagtaagccttctgaacaggcattttaacagtaagagtattaggttaagtaaggtcttaaataaaaaccttcctgctaaggtctttgcttcctctgctgcctttgtgagccaaggggaggtttctcactctttaaaactcctgtgggcttaaaggaaggtagccaggcttcgtgctcttttagctccaaactggtacaaagtctgtgttaaaatagccagtcgaggccatttttgtctacatggaactatggttatggcatgtaaccagaatgctaaaaactctttgctggtaacattgtagactgcaaaaatggcaacttggcagctttttgaaaaatgatgtggagtcgatttcttcaccctttcattctggactgctttgcatattacttggttaatacaatgctacagaaaggatgttggatataatctgagtagtctcaagaattttgaggtatatccactcttacttttggaactctgtgaacttcacatctaataaattactggacgatttgagtccatatggaaaggtgccctactcattccagccagtgaacctaccagctaactacagatgcatgagcaatctctctttagatcaactgagaggaaccagtgtggcccagactagaaccactcagtgaaattcacaccagattgccaacctaggaattcgtgagctaaataactggttattgttttaagctactaaatgtagaagaggttaggtttgcagaaaaactcaacacctagagctatattactttatttaaattgttcttcttaaaattaaatctctctcagttatcaaatcaatgagcatttttcagtccttatctaatgagactattttacagtatctgacagtattgattattcgtaaacaatctatactcttttagtgtctatgacactggatctttgtgcttctgctggaatttctgtactattcattcttcatttcccttgtagattttatttcttcttgttttccttataagtatcagcatttgttaggtttccgtctttttcttatgtttccatccacaaactctccctgttggatctcctccacttttttttctatttcaatgaccactttgtataaagatataaattatgtctttatgcaaagcctcttcctgcattaaagtcctgaatatataatctgacagttaggtaatagtcagatatatgtcccgaggccctatgcttcaacatatcccaaagtatgtaactgcgttcttctctgccatctgctggctggctattcctctatttcacatagtatcacaactagtcacccagcaacctactagagaaacctggcataacacatgcctccctcctcattatatttgtgtccactctgtttctctcgcactgctctagtttaggccttccttctctctcttttgaaacattatgatcgtttcttgactagtatccttagctgtagtttgtttctcttatatctattctaaacttagctgtcaaaaaagttattaaacaacaactttcagagcatttgctacagtgaatttggcaaataataaacatatttgctaccacaatttttgtctctgcctctgaaagttatcactaagtgatttctgcaagattttcatggtagcatccaactacacagccagccattgctattggataggagatagctttaaacctgaaatctgtttgccttaggattgtcaaagattaacaaagcgggacagtagttaacatggcagggatatattttaatcagtaatatactactgcaataaggaagaggatctagttctatcacaaacacctcttctaacatccaggttagttttctttcaggtgtctttgtatgaaacatctagagtgggttaggggctatacctttgtgatcctgtcaaacctatatgacatcctatcaatatgaatacgaaacctatatgaatccctattaatatacctgctcacaattttgaggttttctgatgatatttctatttatttcacttggactctgtgaagtcaagtactgtatcttaaatatttttatatccccatcatttagcacagtacgtgacaattaaaatcagtcagtgattttaaaatttaacaacaacaaaaacacataataatgcgctgacctcctacaactctaatagtgcttgtgggctcaacattatctgaaaattgttcatttagccagaattatgatttcaaaataactaaggactataggcaactcattctattgcctcagggaaacgtccaaggtgtcctacttttgtggacatgtgtcatctgacaaaaggttgtcaagttcactgttctttccagttctgcctggtactatgattgcagtgcctaagcagcttgaatttcctgggcaagtgtgcaccatgctgtaataattcagaagctgtttttgtgttcttgaaacatatggtgctagctcagatttatcttgggaaaagctggtcaggaagagaaactgctgaagagctgaaatctctcccagcagctaagaaaacaacggagggacactggcgtccttcctccgagagctcaggctctccgccagtttgtggtccatatgctgaatccagagagctgcttcacttctaataacgattgtgttaagttgtgtgaggctgatattcctccagagggctcacagtttcaagcatacctaaaagcacctgttaggaagcagagcctcagaaaaatgcattagcatttctaggaaaagggcttatttttattcttcttggttacagagttgcaagttggcttgttcagaaagagctgtttttgcaccacactgatgttcagtttggtgcaacatttaagtctgggaagagcacagagccaaatgtggcaagagatggcaatagagaaaatgccaagtgccccctggcttatctcttgtagaagaatttgtagcaaggcttagaccacctgaaatgaatagcattctgcagttctgtctgaatttcactctgtgatttattatttcattatactagactgaatttgaaccaacaaatagttcacccagggaataaaatatacctttactttacagatcctttcccttcccttcccatatctttttcttctttctgtcccacctccaccaatgtgtgtatgtgtatgtgtgagcacgtgtgtgtgtgtgtactcacatccattctaattactggaaacctacctttgctggagcaggttaaatattgcctcttaaatattagtatgtttagaaagcccattcctataataaaagtggtcatttctacccagttgttcccaaatttcaataaattaatctgaataaatgagtttatagatattacacttagaaaatgcatagttaaaaggaaacattttaataaaataacacttttgaaaaagccaaatttcaaactggaaaatcagaagcaggtagtggccagtgccactagaacatgttaggaaatctcaaagtttcccctccccctttaaaaaacagtgttcctcagaaaaagtatacatatctcatttaactcagcctttttagcccagtcctattatagtgctgtttgttccaaactgttttataaaatatgtttatgctaaaatatgtaatattaccttccactaaataaataaatatattgtacacacatcacatacatatgtgccatcaccaactcctatatgaggactaaagctctgattttttatcttggccaaattcctacctaaggggtgtcgggagtcatgccctgcaaaccacaaattctcatcaggtgggtaccctatatatcgtgacttactttccaatctgactctggcataacattatgagacaaggaagaaaatcaaaatatttcaccccaaaacatgtttttctgccatgtcttggaatggccctacaaagccatcctttgttgggaaagatctgcatctgtaaagaatctctgttaacatagctagatctttttctttcaggccctcccaattctgaagagattaactaaaagtctagcaccttttaaagatctgaataggaaacatttgtcatctattgtctctaactgcagccactataagatttcaaaagaactttggtctctacgatcttttatcttaacccgaatatttcttttctatccatctcaggtctttagacaaactcaacccattgtcaaccagaaaatgtttaaatttacccatagcctggaagccaccccccaacccctccctgcttagagagttgtcctgcctttctgaaccaaatcaatgtatttcttttttttttttttttttttgtgacggagtctcccaggctgtcacccaggctggagtgtagtggcgccatctcggctcactgcaagctccgccttccgggttcacaccattctcctgcctcagcctccccagtagctgggactacaggcgcccaccactatgcctggctaattttttgtatttttagtagagacagggtttcaccgtgttatccaggaaggtctcgatctcctgacctcatgacctgctcgcctcggcctcccaaagtgctgggattagggcgtgagccaccgtgcccagccaaatcaatgtatttcttaaatgtatttaattgatgtctcctgcctccctaaaatatataaaaccaagttgtaccccaataaccttgggcacatgtcaggacctcctgagagctgtgtcatgggccgtggtcactcatatttgtctcagaataaatctcttcaaatattttacagggcttgactattttcgtcaacatatactataatatcttccaaaatgtggtcttaactcacgagagcaaacagtgcagagtgtgtgatattttctaattccatgagtattagctggttgcaaaacaagcattctcagcccatggcactgtgtattccaagtcgagcgtattctttaatgtgtttttattttgcttcactctctcatgttaccatttatctcatcttatggtaaagcagttttgatccataatggtatttttaaaagctaaattttccaaactgaaacacctagctgagtaggccgcgagttaaaagagtagtgtggcaatggctgtagattccttcaaggaagtggttgaaggaagggatggattttagggattggttgaagtcctttaatattttcttcagcataaaaaactgactaaatcaattagtacaaatactttccagagcagtggtccttaaactctagcatgcatcagaatcacatggcaggtgactgaaaccacagattgctggccccacctttagggtttctatttaggaagtcaaggtcgtgacctgagactatgtctttctttttctttctttcttttcttttcttttcttttttttttttttttttgacagagtttcactcttgttgcccaggctagagttgcacaggctggagtgcaattggcccaatctcggctcaccgcaacctctgcctcccgggttcaagcgattctcctgcctcagcctctcgagtagctgggattacaggcatgcatcaccacgcccagctaattttgtatttttagtagagatgggggtttctccatgttggtcagtctggtctcaaactcatgacctcaggtcatctgcccacctcggcctcccaaagtgctgggattacaggcatgagtcaccgcacccagccaactctgcctttctaacaagttctcaagttatgcagatgctgtcaggtggtgtcttggttgatttgagccgctgtaacaaaataccatagacttggtggcttataaacacagacctttatttttcacagttctagaggctgggaagcctgggaagtttaagatgaaggctccagaaaattcagtgtctggggagagccctcttcttggtttatagatggtgctttttagctgtgtcctcacacggtggaaggagagacctagctttctccagcctcttttataagggcactaatcccattcatgagggctccactctcatgacctaatcacctcctaaaggccttgcctcctaacaccatcaccttgggtgttagaatttccatatataaattgttaagggacacaaacattcagaccatagcagcaggagggaacacactttgatagctgttcttctagagaaatgtctatagtgcttttcagtctggatttcataagggttactatggtattatctgagaaaaacaaaaatggtgctacctagctaacttccacagaaaaaaatcaaaaacaacttttctttttttcttttattttctcctttttctttgagagacggggtcttgctgggtcacccaggctagaatgcagtggcctgatcatggctcacagcagccttgacctcctgggatcaagggatcctcccacctcagcctcagctgggaatacacatgggcatcaccatgcctgattgatttttttaaaattatctgtagagacaggatctcactgtgttgcccaggctggtctcaaattcctggcctcaagcaaccctcctaccttggcctcccaaagtgccgggattaggattacagctgtgagccactgtgcctgacaaaaaaaaaaaaaaaaaaaccaaaaaacaaaaaaaaccttaaaactaaacaattttttaaaaaatataatgaatttatattaattttatgtttcttttccactgagaaattaggaaaatgtttagtgaacttttagccacatttaactaggaaaaaaacttcttaattttggcctgaattcctggctacagctgactgaccatcccttgacttccacaacctttattgccatcccaggttggcccctcatcctcagagtaacatcctggagagctgtcatcatccaagcttgcctcatatcttctgtcctaaatttttatgcgccaccttctgcccgcaaacttcttgacatcttcagcctgatttcctcttttccttttttttcctcttttatccatttctcagttcattctcttctgctttcattgtttttctgaacatacctagacctcatggtcaatcatcgcattgatcatttctttctaatattagaaatgtcctgactttcttgccattattcttacacacagtcagaataatccaatctaatcattcttttctctttgacttccacataacaatcattgctaggaaaattaatggttagactgccattggaatttccaactgcaaaatgtcctgtctccaagactagatgagcagtaattggacatatccctaatgagcactctgccgttttccacaatgtttatttcggattgtcatcactgaagtccctttctcactaccctctctatcacactttggaaaaagatctttcctcccatactgtacaaataaaataataataatagccaccaatcattttttcccttcaactttcttcacccttccctatcctgctacttgcggattcactcatctgtgcctcattgtttcctgcttcagaagaacacaagagcagaatcaagagccagcacaaacatagttttggaaaagtgcccgattttactttccatattttatcaccagtgtagtgtatgaaaaagtagggaacatttaaaagttcagaaacaagggctgatccattgcagtctgcactttcatgttccatgaaaaccaaaaaatcaaaaaactcactctattgaaatcatctctttcctggtttatctcttaaactaggaaatagttggttcctaggaaatagttggttaaactaggaatagtttggttccctgtgactcttgcctttcatatctatgtctacagcaactcagtatctagtacatcacagggactgcccagtaaatgattcagtgggtcattccttttttttttttcatgtctaatttttgttgatcctcactttgtgatccacaattattcccttttatttttctcttcttgagtgtcacatttgtgttatgttttatttgcttatctattttgacaaatgttcacatctttttaaaatatacatatgtatgagacataaaagtgcaaagaagaattctactcaaccagaagtaacccttgctagtgtgcatttatcatacgacattctggacaaggctctgtgcatatttaaaatgtgtagtccctgggtattcttctggtttctttctgttattacctctcttaatggggtgggaaggagtagataaaattctacctagagtagctatttgaagatgatgcttcaaatattatccccaagtggtgagggttttgtcagggatttggggaggggggtgaggggacttgcacttgcctcgggacagtctaaaattccaatttaggtttgtcatctcaaatacactctcacaagtctgctacgttctccaacttaggggcattgctctgtttagagtttggtttttgtaaaagttaaagaaagaggaaagaaacacaaaaagtggcttaacagtcaaagacaggtttattttggagaacaaacctgagaggggtttctggacgatttttttggtgaggagcactctctcttacggtctaagagtatttattggtgagagaggttggaaagtttctgtgttggggagaagtttatggtggggttggaatgtctctggttagagggcaggttatctggggtctgacatctctctggccggaggggagggttatctcagggctggcatgtctctggtcaggaaggggtttggaatgtttctggtcggagatgtcatttgtggtttatggtcatgctgaccttagccattaggctgataccgtttagatttaggtggtttttgatcaaggtgaactttaaaatggcagtgctcatccaagatggcaatgctcctgctctgtcagttttcagggtgggattgtgactcacaacaatgttctgtgatataaagagatggccattgctttcccaccctcctcattctcttatatccaaccatctccctgtgctaagaagccagatcaaggcaacaccaatggccctccagcaaggttccactgtacgacttcctctcctgttctaccttgtggatttgcatctaaaccttgtctggctcccttcatccctcagaccactttcacacttctaaacttcatccacattttccacagagtcatcacattgtcttttcagattcattcactcacttttagataagtctgtacttgtctgaagtctgaggacataaatatcagctttaatcatcctccatgattttgatccaaatttgagtatgtgatggagatcatttgagttttaggtttgaagttagtttttttgtttttttgttttccaccacataggaaaagttacactctcctcgccttctcccccctcaaccccaacatgtgtctatatgtttagtgacacttaagggaaaaaagtagaagaaaaatggcctagtgctgctatttttcattggccgtccgtcctaccaatttactttgaaatttgtttgaagaatgatgtactgaagaggaaagatgaacaacagcaaaaagtcccttgttagttatgctttgctcacggaagaccctcattttggtgtcctatgacctgcagttcagttccgtttctctcctctgagtgtccatgtttagcccacctgcctctgcattgggctttatagcctatttgttgttgagtagtgaggattacatcttgttagaaatgtaagctgaaaatagtcacagtggagctctagaatcaactttcttggcaaaagtgctaaatagtcatcttgactctggtaagccagggatactattactactaataaccattgcggcctactgagtgcacacaccgtgccaggtagtctgctaagggcttcagtgcattttaatcttttcaccagcccaggactctgttgttttttgtttttttcttaagtaaagaatttttaaaataaagaaactgaacctcagaaagcttagataatttgtgctagttcatcacactaataagtggtagactctctctgtttgactccaatgactatattcttgaacactatccaaatgaataccaaataactcactttgcaaacatttcatgtccattatcacctcattaatttgttcattttattgctcatttccagaatgctcttgccactccttttatcataaaacatcccatccattcttaaagagccagcttatatctaatcttgtatcttatccttcccctaattatccagcataaaatagtgtttctgcctctgttccccataagcgtgtctgttttaacacttatttttaatatatcagttaatgttagacatctatcacctttcggtctcagagttgtaccagttcccatctcctactgtatctggtaaaggacagctttttgttttgattttcagaacttgatttcaatatatatatatgaaaagaggggacaagataaaataaaaaaagtaacatttgatataataatgtctaagtcaaattctaggatttactaggtgtgttatattagaaaatgcaacagggatcactaaacctcaatattgtcttctgaagaaattatcttcataataaaactacttgttttacctttgattgagtttttaagagaaaagcaaatacaataataagtgatgaagtattataactcataatgtgctatgttactgtattttgtcgttgctgataaaaatagttgattgatgactttttaagtgacttttaggcagtctagagtgagcagtaaaagaaattaaagctgaaacagtgaacctaaaattctgttgtagaagttgttaataactgtcttttcttcagcagaagttacctagttctacattgcctctggctttttgccacccattaagataaaaagctagaagataggaactaggaaatagtagagataaggtgaaagtctagcttgaactcagtgaagcaaaccaaaataagcaaagatccctcacttggagatgtggtagaagacttgtgtgaattattacagtgactaactacacagaggaataaagttatacatataaagttaaaagatatgtaatatgagtgctcctgttgaatcagccaacatgaattcagtcatatagtcacaacagtgtgcatcataaaacagtatcataaatagcaatgagttataaatggaattgaccaatatacttagtgagaccaatatacttggtgagaaactacactgtgttattactttgtacaattataaaagataattgcccaatataaataataactaaaatttaagaagaaattttctatttttaatctagattataaaatgaatgatagttatgtaaagtttatctatttttctttggaaggaaaccaaatctggagacataataataatttggtatcatgtaatgcctaggaaatagtacatatctaataaatatttgttgagtgaataaatgaatgacagccactgtaataagttaaaaagtttttgtaggtaaaagacaaggctgaaacaatgattctgactcataagtggtgggccattaattatatacatatatgcagagacacacacataaactttaagaaaataaaattttaggaaaatagataaaatgtcaactagtattttattgttctgctaaatgaatttgttgtcattcatgacagtgtaatgattccatcttgtgtctttgtgtaggcacatgtgtgaaccactttaatccccctctttttaattttctaacattaaaaaaactatttttttgtgtccatgagacatacagtttcaaaattattttatgaaattgaatggatagtataggaattaatgtcatgtatatcacagtgtgattccttttaaaactgaatgagaggaagttaaggcatgcctactggttttcaggggcatctagtaactttgagttattaagtaatgaaatgtgagtgacggagttcaagttcctattaaacataaggagaaaaacattcatatagtaggtttaatcactgttactttacactttgatgtgcaaattaaaatcgagaacgtgtcatttaagtaggcttaagagttattcagaggtagaaatatgacagcagctgacctttattgttatattttactgcaacaaaagctctgtggatgttacgcagtttctagtgtgaattgtctgaaggtgataaaagaattcaaatatctggactgaggtatatattttaggagatagaaaaatcactttcttaccttcggcaaactttctcattgatcacaagagtcaaagggcaatcttcaatcctctaacttacatcacatggtaaactacttcctttgcaatccataaaatgaaaggtacaggtgatattctgcaaatacaataagaagattctgttgggttacgagcgtcttgtctgattaatttttacattccctggacctaaaataatacctgttttgaaacagtagctccatgagtatttaccgaggtcagcagaatttcattaactgaatttaaatgtagtaattgaattacccacacaagtaatttagtttgagtagttttacttagctaatagtggcaagcataacattaaaatgggcaaagaaataagcataccagagttctgcaagcattttctataaacagccagataataagtattttaacttacgagggtttaaaaataaaattaaggatattatgtaggtgcatacataacaatttaaaatgtaacaatttaaaaacaaaacaaaactatttgtaactcacaagccatacaaaaacagacaactggcactttggctagtgggctacagtttgcccttccctgaaacagatttttgtgcaataaattcaaagattttgttcccgtagttgacctaaataattctgtagatttggtcctccatgatgcaaatttacatagacaaggtgattagacagatgatggattgaaatcaatttcttgtgagttaaattaaacaattgaaatgaattgttttattatgcctttgtctctgcatataagttagcaaattctgggagccaagtggaaaatgtggataaaaggatttaagcatgtctggagcccctagggagaatggcatctttggaagaaaaaagttagtggagttcaaagtgtgccttagaaaaggatagatttagatagaagatctcatccctggtaacaggaggaaggtcatatgcagatgggctttgggaggagtgtgagggtgagttagttggagcaggtgagggcagtggagctcactctactaacctggcagaacactgtggtcctcaaggcctgatgtaagtgcatttagctctgggagacattagacacaagtaagatctattcaggaaaatgttattacttgttcccaaaaggaattctgcaattctgtttggttttttttttgttttttttttttgatacggagtctcactctgtctcccaggctggaatgcagtggcactatcttggctcactgcaacctctaccacttgggttcaaacagaaattctgcacttctaactgaacaaaatatgcaattaaatacacatgagcaatggaaataaattaactttagtcaattcatttctgtagttaaataacagtagtttatggaaaattagtattgccttatcaaaggagccaaaagccattttcaagactgtaaaacattttatatgtagtagtattaagtggtgtaatagtaaaatttaaaagaaaaacaaacaaacaaaaagaagatgagcaagcctcttgatctttctgaattttagcttcttcatgggtagggtgaagatgtgttacttaatgtttgccaatgtcttatctatctttacaatgccaagaagtcataaaatttttatgttaaatatctaaagtataaaattactctccaaactacccaaggtacacatgtatgtactcatgcaacacttagacccatagttcccaaactatgtgtcaaagtgccttagggagctttaggcttgtgggtcatacaatttcttacaaaataactcaactctgtagccctaaagcagacgtaaataatatgcaaacacatgagcatagctgtgttttgacaaagctttattttcaaaaagaagtggccaacacccaagctgtacttcactgaactctggtatacagtatatacatatatatttatatatgcacattaaatatatgcgttgatatgcgttcaagcaatgtacaaatatatgaagtttcctaattgatgaataaaatgataaacacataaatacttaagtgaagaatggagagaaggaagacagtaggtagattagagatagcctgagtcaaaaggaataaaagccactagtcagggaaaagagcttaatacattcatatacatatacacatacatatacacacagatgctcctcaattttacaatagggttttatcccaataaacccctcataatttgaacatatgatgggcttatcaggagagaaccccatcataaatcaagaagtatactaaatgcatacacttttgtaccattttaaagttggcaaatatatgttgaaccttcctaagttggaaaatggtctatctatacatgtatgtacttgtatatttgttctctgttcctctatgaaatattgatgacaaatttgttatttatttgtcgtaacagttcgtctcagatgtgatagatacacagtgtgtatgattatgaaacttgtaaaaagttttaagaataaataaatcaataaacatccatttcaatcctgatagtaatgaagtttaaactcatttccttggtactgtctcttaaaaatagtaataaaaggttttgcttgagcagaatgactgcctaatgtagacattacactcttgtgaaaataaccactttgataatacaaagatagccagtctggtagagattaaactgagacagctaagcacctgtgttgcagacattcagttggccatgttatcaagacccaagatattgtaacaaataaataaagtcatagtagtaataataataaagctaatcaggccaacagaatgccccccaaatttatttccacttaataaatgctcttctaacctcatattaaaaattgtgtctctgattccagttaaagaccaaattttaaaaatacagagactccaaatctgattctgtattgaattctaatgtgaagatctttgctggaatgcttcaaaggagattagaaatattgattatcatttaagtactcttagatcaccaaaatctcactaatgaagaatttctttatatcatgactgtgattggctagttaacaaactataaaatgaacatgtaatacattaatccctcaataacatgacctggaatccctacattctaaaaatatctctttgttttctgcctgtatttgacagaaatacggcattaatgaaatgttcagttcttgcttaaagtacataccggcataatttttcaaggaatgtagggcttcaacacttcttaaaagtcaagtttgactcttcctaggatagaatatagaggtatgattaggtaaccttaagtgagagagagattgcacgtagaaaataaagcttattctgccacctagaacagttttttgaatagtccttgttatgtctgaatcttgtcactcaggtctcagttgaaatactagctttctacagagatcactttttgatcactgttttaggaaggggtctttagaaattagattttgggacagaaatgggtatgtaggaagcttactggaaattgccttggaattaacacctgtagtggggtgaaggaacctggactggcagagaaatgtagtcaaaattaaggccacagcagattcatctttttcaccaggagctctggtgctggaatgcatctgtagaattattccaactttccccagaggagtaggcattcatgtccccatatcagtcagccattggatgagggatgggtgcacacgcatggttgtcttacctctccttggctgaggacaattcccagagcaaggctctgactgagagctttcagccaaaaacactcccagaagttgggggagtaacagcttcagtcctaatgagagaaatagatggtttaaaatggcatctgcaacattctactccctgcactattcagatacttgtgattcatatacagtcatgcatcccttaccaacagggatacattctgagaaatgggtccttatatgatttcatcattgtacgaacatcatagagcatacttacggaaacctagactgtatagcctactacacacctagggtatatggtatagtctactgctcctgggctacaaacctgtacgacatgttattgtattgaatattgtagtcaattgtcacacaatggtatttgtgaatctaaacattaaaaaaaaggtacagtaaaaattcagtactataatcttacggcaccaccattgtataggcggcccatcatttatcaaaacgtcattatgcggtgcatgagtgtattaagttctggaatcagctcctctagaatccctggaaaaacacaaaaaggacagtaaatgagacaaactacagcccatgcactatagctagtcagaagtcataaatgatattcattgtttctctcttccattatgatttctagattcacctttaactagtgcttctgaagatctgggtagctactaaatgcagaatgtcatatctgcagggtctgggttcttagtcatcataaacttctcaggccttacctgtttctcttgtccagttaccacaaaaatttagcaacagagaacaaagagatgcctcaagaatcaccaggtttaggccaggcacagtggctcatgcctgtaatcctagcactttgggaggccaaggcgggcggatcacttgaggtcaggagttcaaaaccagcctggccaagatggcaaaaccccatctctgctaaaaatacaaaaaaaaaaaaaaaagaaaaaaagaaaagaaaaatagctggacgtggtggtgggtgcctgtaatcccagctactcaggaggctgaggcaggagaatcacttgaacccaggaggcggaggttgctgcgagccaaggttgtgccactgcactccagcatgggcgacagaacaagactccatctaaacaacaacaaagaatcaccaggtttattatatgggggccatgcaaattcttccttgtccccattgtgaaacagcagccatactttctcccggtgatcaaggtagcatctccaggatgactatcactttatttgtctcctggagaactggtatgagaaggtccaagtgacaaggtagcagctatagcttaaatgttaatggggcttttgtggcccctcaaggtcaaggacctttaaacctctagaaccaagaactgtaaggacagaaagcatagattcctaggagttcaaggcagtgagctatgagtcactggaagtaatgatacacagagccattacttagctcacatattcatgtattatactgttgaggatgtactcatacacaatggtccctcatgtagagtgcatgctgtctcctggaggatgggtcccctcagtgtgttatttccaagatggtgtctctgttgtgcctttacaaggatcttcttttgctctgtaaggctggcagcttctgagtgttgtagggtgtgacagagccagtggatcccatggatatctgccacatctcctttgctgcagtgtgaattacttggttcaataagatctaacatatgacataaatgttgatgtagtaagcagtctttagtccattgtacaatggttctgacagagaccctgtgagtagaaaaggcaaatctattcttggttatatggatgatgccactcaagatgaatttctgctctttccagagtgaaaaatatttaatacaatgaacgtgccaccaagtggctggttggtcttctgaaaagatgatgtcatatgggaggtagagaacttgtctctgttggctgcatgcagtggttcacacctgtaatccaagcactttgggaggccaaggcaagaggatcacttgacatgagttcgaggccagcctgggcaacagggcaacaaagatcctgtctctataaacacccttaaagaaattggccatgcatggtggcacatgcctgtagtcctagctacttgggaggctgaggtgggaggattgcttgaacccaggagtttgaggctgcagtgagttataatcttgccacaggactttagccgctgagtgacagaatgtgaccacgtctaaattaaaaaacacacacacacacacacacatatgaaatatatataaaggaatatataagaattatatatatacacacatatatttgtatatacgtatgtgtgtatgtacatgtgtgtgtgtatgtgtgtgtgtgtgtatatatgtatcaattggtctctgttattggcagcttaggtatccaaagtggcggtaactaagatggcatatgaaatatgctgactgacatgaactggctaacttaacttggatgatcactgcctcttttaagttgctcttgggggagtattaacctgtgacacaaagatgttcacaaattatgatcattcccatagatccatccacatatctaatttccatatctcctttttctcagtcataatgtttatccttccaggcccctgaacaattagtcaattcaccacagtccatgagtctgtaaacatccttatcttgggccacttttctttccacaccaaatggaaaactgcatcacttgcagctctcaccactgggagaacttattcttacagttgttttttagggtcacttttagtttttacccacatgctgagccaactcccctgtgaaccaagctcagtcactttcctgctcggcccaccagtcatatttgtcctcatcacgcagccacaggtatgtgctgtgggagggattttgatgtaatagtgatggatgacatggagtctgggctacctgattacacatcatagttgtgccctctatttctgctcttgctcaatcccaggtgtgcaattccatcttttgatggatttcttctgcacctaccccaccttatggctggatgagactctcagaaattcatgatggaaatatctggttacaaaatcacttgatatctcgtggttggctgacacatatctcctaataactgcttttggtatatagtataattctccagtgaggtggcatgatcttggaccagaactctaggggtgtacattgtgattctcctgtcagagtttgccataaactctgcattctttcctaccactgatatatgtaataatatgttatcttttggatcatacggcccaagtagggaagccactttctcctacaccccctacgaagcatttttcctcactagttttcactgaaaacaggcagcctttgctgtcacacactaatgggtagaatgagtattctcaagtgtgaaacatgctgtctttagaatccaaagtagtgctgcactttgtcttttaatttgattggattgtttcaacatgccaaagataactggactcctaaaaacatcactgctgtggttggcccttaaatcttcatggggtttatttacactttctaggccacacatgtttttccaaggcctctaacgcacttgcaacgtcttgctactctagttcagttaatacgaggttatcaatacagtggaccaatttgcaaaatatttgggtacctgaaccaattctgcaaattagttacatggtccagatttcttctgactaattatgaataggagaaatgaggaagttaacatagagttacataaaaaagtaaacgtacagtgggaagtattagtctgctagggctgctataacaaaatattataaactgagtgacttacacaacagacatttattttctcacagttccggaggctggagagtccaagatcaagatattggttcctggtgagggcttccttcctggcttgcagacagctgccttctcactgtgtcctcacagggcagagagagtgatagagagctctggtccctctttctcttctttcactcacaggggctccaaccctcatgaccatatataaacctaattacctctcaaaggcctcacctccaaataccatcatttttagggttagagtttcaaaatatgaatttgggggaacattaacattcagttaataacatgggggaggggttttttgtttgtttgtttgtttgtttgtttgtttttgagatagggtctcactctgtcgcccagtctggagtgcagtgatgtaaacttggctcactgcaacctccacctcccaagtttaagtgattctcctgcctcagcctcccaagtagctgggactacaggtgcctgccaccacgcccggctaatttttgtatttttagtagagacgaggtttcaccatattggccaggctggtcttgaacttgggactttgtgatccacccgcctcggcctcccaaggtgccgggattagaggcgtgagccaccacgcccggccatgggggagttttggtacagatttccttcattgactgaaaaaaaaaagagtcataaagaaaaaaaaaactcctttttgcagccgcagccaccatttctccacatcctgtcctctccatctccttttctcacatatagtgacagtgtctgaagccgtggcagccactctgtggctatgtaacaacaaacccaaggacaacagggccaacacactgaaaactgtggaaagatgataatctcttgggaccttgatgatacctttaaattgtagaatcttcctatagttcttgttatgttagaaatatttcttttatttgagctgaaaccatttggattagttaattatagctgctataaaaaatgaactctaaaacagaaataacttaatacataaaaatctcatctctctcttacaacagctaaaacaggggttttcagttgggttattctccttcagacaatgattctgattctctctttttttttttttttttttttgagacggagtctcactgtgtcgcccaggctggagtgcagtggcgcaatctcggctcactgcaagctccccctcccgggttcatgccattctcctgcctcagcctccaaagtagctgggactacaggcacctgccaccacgcccggctaatttttttgtacttttagtacaggcggggtttcaccatgttagccaggatggccgcgatctcctgacctcgggatccgcctgcctcagcctcccaaagtgctgggattacaggcgtgggcaaccacgcctggcctcagacaatgattcttgaaccaagtcttctttcagattttggctccaccatctccaaaacttggtttccagagttaacttggatatcacctcaatttctaattttaggaaatgagaaaggaatatagatgattatgcatgggaagtttttaatggagaaagcctaaaactaggttgtatggttactcttaactgcaaaagagaattcaaaatcgtttttccatgaagaatcagaaaggggaatgactttattccctctacctagaatagtgcctgactgatagcaaaaattcaatgtataaccatttaatatatgaataaattagtttgctttgctctgcttcccaaccaggaatgtactggttgataattacttatccaaaatgcttaggaccagaagtgttttggatttcatattttttcagatgctttaatatttgcatatactgtacctaatgagatatctttggaatagaacccaagtctgaaatttatttctgtttcatatacaccttaacacacagcctggaggtgattttatacaatatcttatacaatatttaaaataattttgtatgtgaaacaaagtttgtattaagtatttatacatggaattttccatttgtggtgtcatgttggtgctttaaaattttcagattttggagcatgtcaaatacatatgtcttttttttttttttttttttttttgtaagagacagggtcttgctctgttgcccaggctggagtactgtggcatgaccatagctcactgcagccttgacctcctgagctcaagcaatcctcctgcctaagcctcctgagtggctggatctacagaagctgccaccacacctggctatagacctaaacatatgtcttgcaaatgtttcacatgaccatagagtgagatattacttacatccatgaaaattctgagttctagagaaacaattcaaatggtgctgtttattattgattgattcataatttcatttatatataggcagtagcaatctgtctacagcctccttagtgataatatatgtgatcttccttgttccttcacactgagtaaggtttcatccctgttttttgtaagaggtagtctgtgttttttcctttgccaataactcagtgagagaccactgccctccaatataacatcaaaagtacctgatcaactaagtcaaaaatttacttgatcttctcttatgttatgtaggaaaaaaaatctgttttggccaggcgcggtggctcatgcctataatcccagtgctctgggaggccgaggcgggtggatcacgaggtcaagagattgagaccatcctggccaacatggtgaaaccccatctgtactaaaaatacaaaaattagccgggcgtggaggcacgcacctgtagtcccagctacttgggaggctgaggcaggagaattgcttgaacccaggagccagaggttgcagtgagccaagatggtgccactggactccagcctgggcgacagaacaagactccgtctcaaaaaaaaaaaaaatctgttttataaaatcaacgtttgcttgaattgattgaatttccccatggttacaaggaaataacctagtttgccaaagatgactcacagagtttatactttaccgtttgtctttagcacatactcatatctaggtctacctctctattgattattcttccttaaaatctttttctctgagatgattatgtcatgattttacacatccacatgtatattagtctgttttgcattgctataaaggaatacctgagactggtaatttataaaggaaagaggcttatttggctcatggttctgcaagctgtccaagaagcatggtgctagcatctgcttctggtgaaggcttcaaggagcttacactcataggaaaggaaaaaggggagcagatgtgtcacatggtgagagagagagagagagagagagagagagagagaggagaagcaggactgacttttttgagcaatcagatttgatggtaactaacagaccaagaattcattcattaccatggtgacagcaccaagtcattcatgaggagtctgccccgatgacccagacatctcccacttggccctatatccaacactggggatcacatttcaacatgaaatttggaggggacaaataccaaactatatcaatatgattctgcacatgaaatgggttagcatagttagagataattaactaggctccaagtctattaagttaatataaatcctaggcaaataaattatttatattttctaacaaaatatgtattgaagctaagcaggcacatctgatgaatcattcactcttttgtttgttgtttctttttaattacacaaattttcagtgattatattgaaaatcatgcaggcaaaagacttcgaataaacaaatgaaagttcttaaaagaaatgttacatcctaatggcaacacaaaccttctaatttttattttttaatgtaacttagaggctttaagtcacaggtcagattaacttctgatgtaacccagctatgcagactgtttcctactactgaagacatgaacatacatagaatttccatcacctaaaactgttttggcatcattgtgatggcctactgtacttttgcaaattactttatcatccttgctgctttgctattcttcttgtcaatgccatgtctctgataatgtcactttgaacagtgattgtgtgaatgctcagaattactaataatttccacagacagtatcttgtagtgaggtagtaacagaatatttttccattctgtgtcagtgtcttacaggactgattttttacaagatggctttcttggcatccaatgcaaggactctcaccccaagagaaaactttatgcacgaattagaaatgagggaataaagtttcttaaactaggactgcatcagaagatgtgttctctctgtctctgtttttttgtttgtttgttttttgtttattgagacaggggtcatgcttcgtcatccaaactgaagtgcagtggtgtgaacatggctgatttgcagcctcaatttcccaggctcaagcgatcctcctacctcagctccccgagtagctgggactacagcgcatgccaccacacccagctaattttacatttttttttcttgagacaagagttttgccttgttgcccaggtctgatctagtcctgagctcaagcaatccttccaccccagcttcccaaagttctgggattacaggcctgagccactgcacccagcctgatgtgtactctcttaaaacgttcttaaaccgggccgggcgcggtggctcacgcctgtgatcccagcactttgggaggccgaggcgggtggatcatgaggtcaggagatcgagaccatcctggccaacaaggtgaaaccccatctctactaaaaatacaaaaaattagccaggcgtggtggcaggtgcctgtagtcccagctactcgggagactgaggcaggagaatgacgtgaacccgggaggcggagcttgcagtgagctgagatcgagccactgcactccagcctgggcgacagagctaggctctgtctcaaaaaaaaaaaaaaaagttcttaaaccaacaattttctataatcactaattaatgatgatcatcataacttcaaccacggtatttttaaaagagatatttaagagacttttcccctgataatttttatattacttaatttgtgtattataacatgaagggaatagggatcaccgatttgacagtctattgttcagtctaattaagtatatacaaaactgaatttccttaaaatactgaaactcaaggattaaaaataaattgtttagtaagagaaaggagaaacaagaaagccgatgggaaagacaataaagaaggaacaataaaaagtttgtgggattggttatagcttttttttttttttttttttttttttttggtgctagccataagatttatcatatgtcagataactagaaaatcaaagcctatattttaaaatccaggagccaaaatttcgacagctgttttttaaacaatgactcagattagctagctagctaggtaggtaggtagataaatagaagatagatagataggtataggtataacaaaatctttttcaatttacatcacgagtatcttatgcattaccatcttattataaatgcaaaatgtactttaaaatgctaattttgagaaagataatgactaaggcaattttatagtacttgtgatttgttccgttagtatattactattacaatttcgaaagacttatagaacatttttagtcagtctttttaagaaaacctgaatgtgcaaaatttaaaacaagacattatcttttataaaagaatatattaatataatctcatctttgtttgaagggaaaagacatcaaataacctttatttttttccaaattcatgaatttatacatatttgatcagtataagtttttgagattacttcacataaaattaatcttttcagaattattgctgttaatttgatcacccagaataccagtgatttactcacccttttcatggtactggttttcactttcaccagcttacttttctgggtgatatatggaccctccatagatatttacccctagaaaagaatctacctattcctaatatgtatgtatctcaacttacatagatgaaatatgcagggaaaggagattgtggatttgtaaatctggagtagaatttaaaaaatcactgcacagatagaccaaagtttgcaaactcagatgccagcagaggtttggtaggtaatatacaagaattgaacagccatatataaaccaatatattggggtgaatttgaaagcctacgccccacgcaaaaagagagcacattatctacaaagctcaagcaaattatttccttgctgaatgtaaaatctatctttccaacatagaagaagtcagaaatccaattctttatgtcaactcagtctcagttaaatgcaggtaagcaatttgaattactgtattaaacaatgtacaaatcatacaaaacaaatctcttggagacatttggcctaccagtaagccaatttaaaacctgtgtggggatctagtgcaggaattacagattttctataaccaaagtctgaaaaaaaaatttaaattgaattttagcttcatccaacatagccactttttctaccattacctattatttcattcctgttagctttaatcatttacctgcttgcaggtcctgaatgaccttgagattgtaactaatgttggtccaaaaatctcactgacaatgttattgcggcatgatcagtgaaagagaagttgggttcatggttgagaaacagggatgagaaatataggagactggttgaatggaggtatggtggaactatgacaatgcccctgctgtatcagatgtggcccctgctgtatcagatgtggcacctcctcatccatttgagcagccatagctatgtagaaaaatcctgaatttatgtcattaaagatgtttgatgttaacataaactgatcatttataaagtaaataatagggatttggcgtgtgtgtgtctggccttgtcagaagtaaacaaggagaatattcataatcttactcaagtcatctggggaaggattgccccttgtagtaatacttttctggaaaacaaagaggtttggggatttcttaaccctaatgctttctagaatctcagggttcagttaaaactcaacattggcggccaggcatggtggctcacgcgtgtaatcccagcagtttgggaggccgaggtgggcagatcacgacgtcaggagatcgagaccatcctggccaacatggtgaaaccccatctctactaaaatacaaaaaattagctgggcgtggtggcgggcgcctgtagtcccagctactctggaggctgaggcaggagaatcgcttgaaacaaggaggcggaggttgcagtgagctgagattgctctactgcactccagcctggcaacagagcgagactccgtctcaaaaaaaaaagaaaaaaaaattcaacgttgtcaataaatatctgatggtgacgtacaaagaaaaagctagagagaatttcagtttaaagaattgtaagttctattaaggagatattttttaacacagctcaaggaaatattatccattcctggaatacagtggctctcaattggaggtgattccttcacgctgaatccttggggacacctggcagcatatttggttgtcacaaatgaatgtggaaatgtgactggtatcaattggatagaggccggactttacactaaacatcctacaattaacagagccccccgcaagaaagaattattcaccctaaactttcaacaatgctgagcttgagagactttgctgtagggacaaaaacacaagtttgagaatttgataattctctgccatcttcaagctacatggattcccataagtaacttagcaagtatgagcctcagttttctaatatggtagttgggcaaaataaaatatatcaaagaacttgtgaggattagtgaagtaaactctgtgtaaacacctaccacagcgcctggcaaaaaagtcaggaagaaaataataattacctctcgatttcccaccctcctttacatcgacttctcacttcagtttctccagactaactttttggtgatcaaccatttcatagtgatgacgaggaaagtctaaaaattctgggtttggaagtaagaaaaaatcagagcttttgtaccaccaggatcagttttatgatcttaggcaaaccaacttagtctccgtgttttagttttcttatctgtcaaaaggacaaaaagacattttcccttgcctgtcttggagatgaaaataaatgaattactaggaaaaggagcaattttcccaggagaagtgatctataaatgacttgtgctttagcagtgtatgaaagcactttgagaagtatggacattatctaaattaaaggatttaagttattttactataagttacattatttaaatataatgtatttaaatagttttttgatgtgtgctatttattttttaagttatattttaaattagagaactatctatagcattaaaatatatatagatgagtctcagattaagactataaaatttctcacataccaatacacatttcatctctgaatagtctttcttttcatattttctcagttttgtttcttcaggtagttttctttatacagtttaaataaatattttgatttttttcccctgatttactagctttagatagtatcattttattttacttttcaaaagtttaatgacatagtgacttacccaaccatatgttctctttcctttcctggagcttgtttatattggtattttaaatttgtaaagtttacaaatttcacatttaatatgtagctaaaattgtgctctagctttactataggttgattttaaaaatataagcacaataaaaacgacatttatgatttcaaaattatgtgaatatgcaaaccaaatactgaaattgaaactgtggagaaggaaacgcaatcctatggcactaaagttctaatgctcaaaagataatgtcccaagcatacacaagtagtagcttttcctttcttatgtgcttatgttttctccacacatcttcggtgaccactaactcatgttcataatcatcctctcactttctttcttgaaggtgtttttgcttttttttttttttaaattacgttgtatagctttttaatgctcattggtttcccagtaagcagactctgaaacaaagatttgtgttcaggaaattgataggacattgattggattttgttcctaaggatcaacttggtgggggataaggggagacaaagtgagattaaacaggggagcaagattgagtaaaagaaaaagctggcctgtggaacactcataacaaaggcctcaactgatttcacagggaatctcttgggtggagatgcccctttgtcattgttccagctgccacaagggagtaggcatggggtgtaggttccacccaggaggcggtgtgatcttgggcaaggtgactctcgtcaaccaggacaatattgggatggtgggtggagaggaactcagctgcaaactttcagccaccaatactcccagcagctgggggaaggcaagcttcaggcctgaaatatgtgacagagcagggaaaaattcaggccacatgtaataggatccatccagagcaatcctcaagaggtagatttctcacgagatccttgaacatttggaaaactgggtttagttttttcattatccttcactggtaagttaatgaaaagtagaaataattttcctcaaagtgtttcttcattgtctttttagtactcagtgtctgatgggaagtcaagcggccaatcagattcctgctgtgtggtgtacatgttttactttttctctctatggaagattgaggaaagtttccctatcctgggagttctgaaacttcacaggatttggagctttttaaaattctaatcagcctttgtatgtttttaataagaagatgtgccttcccttctctgaagataatctttttctaatttatttccttgtttctttcattcactatcacagttcttttcacctggaactcttgttagataaaatccagaatattgtatattttttccattaaaataatcttttcctttattattcttccctttgtcttttcttctttttgtttcctgggacattttctcaagttttatcatccagatcatcagctagatccttaggtatattcattttcctttccgttctataaagtaacattaaaaatttttattttacattatttttcttttacttctttttatatggtttctttataaacatttattgttattttaattgacaaaatttgtatatatttatcatgtacaacaagttgctttgaaattctgtatgtatacattgttgaatggctaactcctgctaattaacatatgtgttacctctcacacttaccattttttctgataagaatatctaaaatccatcctctcagcagttttcaaaaatataatacattgttattaatacatactgcatgatctcacttatatgtgaaatcaagaaaaaagttgaattcatgaaagtaaagagtaaaatggtggttaccagaggctgaggtagcggggaggtgttggccaaaggatacaaaatttcagttaggggaaatatgttcaagagatctactgtacaatttggcgactatagttaataattctcttttattttggcagcattctcttcttttatgaatacaagtgcttgcttttctcttaagtctgtgctgtagataatttctacctctgctttagtcagccatatgcttccccattctggtattttcgttcacatttggttcatatgtttggtggtctatgagtcattatttcatgaataaaaacacaactagtttaattgatataagttgtttgcataggtttactctgcagatacataggtctggttcccaaagtgactaagttacgtgtgtgtgtgtggtatatttgtgtgtgttgtgtcagtctggactaaattttatataatcataacatgtaatattatatatcaacatatataaaatatataacacatacaatatatgctgtattttggtgtttgttttgtatgttttacttgttatatataccatatattatgtttcatatgttgtatatatgctatatatatatatacataatgtgggtatatttaaatgtgtctatatgtgctttttaaagtctaaatgttccaaatggttcttttgcccccaaatgtgtcttctgttagccttaaattctcattattttaaatattttcatgaagtatatcttagacacgttttttgctcttttttgcccataagaatcctcctccccagtcccaccccttggcccaaggaaaacacttctaatctgattagtgtgaagtcaaacaatagtgaattcgtactcactagcgtgcagattgagtatgcattaaatcatacatgtccattttctctgtctccttggtacttacataaaggtggaagaggactaggtttccagtattcgccatattatgcttcatctcctctccacttccttcatctatgtgaaaagtccaagaataataaacccttgagatacatattttggggcaacatataacgttctacataggctgctcaaaactggagtttacaagagcggtgtattaagatatcaagaacttgtgcaacccttaatattatgttttggttcttatttagctgttattctttttgtgtattgccctattgaaaactgttataattgatcatacacattgagtcattcttgtcatatccaaactgaaacagagtctagaagctgggggaaaagcactcagcttataaaacattcctccaagaatgtaattctctgcaagtctgactactaaaattgcttgttgtaacccgaaaccagttttatctacagcttctgagatgacttgctgcaatgctaggactaattctgcccaccaccattgctcaccaatacgaacttgccagctccccaaacacttactagtgtcagcgaactttctcaaagaacagtatataacatatctccttttttataaaacctctagccttctctttgttctttggacctccagaatacccccagtccatgtgtatgcctcaaactgcaattgtttcttcacaaacaaaacattaaatttggagatttatctttacatatttattctgactttgaaaagacatagaaaaagagaaagtatatgagcatgcatttgatttaataaaagtctcactcctaattcctaattcctagtcatgcccattcaagcattctactatgtctgcatgaatccatttaaaacagtaaatattaatgaagaaaaaattctcatttatcaattagcacccaccaatatttattctcaaggagttatattcacgatctagattctctacatgtgccaccaaacaccccacttttaccgctcctcattctgctcaggctcctgcattcaagttctaactccacttacctttgtctctctaggagaaagtaaacacacattctaacgcaagtgagtattttttggtactgataacattgaaaaatgtccaattcaaaatataaaatttctttcacatcattttatgtcacactagtaagaaatactagaattagtaacaaattacttttcgcctgcctctattctgattgtaacttaccaatgtgtttctacttcgagattgagaagtatagcattaacacgttggaattaattccctggtttaactagaaaactgccaacaagggaagtgggacataaatagtttgataagaataaagaaaatccaaagcgttacactgcctgcaaaatgaacaggtacctgtacctgttcacaaagtgaacaggtgagcagtcatagggcactatgctggttcattgcctaagacggcacaggtaggcttgtctatgtgtatgaccgatatgtgtgtgcacatatccgatatgtgtgtgcacatcggagacctacggggaggtttgcaggaggtgttatagaaaacggttgtttcttcatcattttgccaagagctcttgtcctccaacctaactgtgtccatacacagtggagcattatttgagtaaatgactgagctctgggaaatgggtaaatgaccccaaggcagaaaggtgtaaataggcttgcctgggcttctgtgtgtgttactctgctgctgtgacaaccattgctagcataacaataagatccagggttacctttatggttgtgttgagttgttggggaaaaattagaagagaatttggatcatctattctcaggagacccgtttgaatcatcaaagcttaatgtcacttgtctctatctctttcaaccatgcattccacacaccaatttgcttaaatagtggatgcacatgccaaatctaattatcccttatctcacaaagtcattaatcattcccatccattattcattgactaccaatagctactccaatctttagtacatgcaacttcagtgcacattacaataccctgtttataagtggcatttatctctgaaacgtaccgcatggcatttttaagttagatgaaatattcctggcataaaaactggtggtgtgttttatggtgttcttctcgtaatccataaaattagtaatataaaaagaaaatgctcaagataattgtgaagctgcagataattattcatggtgatgttaattagcacagtgttgtgaaaatggtgcacaacctacacagtattcagggatcgcaaagtactttgaaaagaggttgtatattatccaaaaaaagcagaaggaaagtggtgtgagggatagattagcctagttaaaagacaaaaacaatgtgaaatttggggtaactgaagcattctctagccatttaatattctcaactgctgcatactacacaattcatattgtcccacatatactttaaccttttgatttcctctaaaatatttgaggggtacttaaatagacacaatgattaagttcaaatctcattttttttcccaaagacacttacacagtctatgggacagcagagatttgaacacagatctcttgatggcaacccagagctatttcgttaatggatttattggatgaaaccaagtttttttcagtgccttctacataacaagttactatacacagtgccattacatagcattttcagaagtctattgaaaacgctaattatttatctatctttatatctatattttcatctataacctctatttatcatctatcatctttatttatagatgagaaaattgagagtcatcaaggttatgtatttttcccaagcttcctagttaataaataggtctgccatgatcctaatcttaatttatcagattcaaactgtgatgtgcatatttccaagactaccttttgttagtttcctgtcttgctggcaagtaggaaggacttattctttctttataataaaaatgttaagtttcaaagattccatagagaaaaccttgtccaagccacttattttaaagataagaaaactgagactcagaaaaggtacttctttacacatatataattgttgtaaactttaggtaaagcacgcatttcctaactattgatcttattggtatattttctataacattatgctttcctcttgagaggctcacaattggaatgtcatacaatcttttcctcttgtattttctctctttctagttaaaatcaatacataatgtaacattgagctcaaaaccttcatcttccataaatttttatcagatttcttgtgcacaaagaatttatcttttcttggaactaatagaacatatatatgattcaattaatcttttccatttgctgtatctttttatttattctgcctcataatcactcatagtttcttaaacatgttcatatcttatcccatgagctagatgacaaagttctgtgagaaaaactcgtacacttcctgtttctacactcttcctgttgtattgccttgccatggtaagcactcaattagtatctggtgattgcttgcttaatgtttgaccaggacaaagagtagattatttagcctattttatttacaaggtacagcaagttaaatgatatgtggttttatcattaaaaagtgaaaagggaattaaggagattgaaaattcactgcaatgttctgcctgctaccatgatggtggaaagccaaaacagcaattttaccagccagcttttcctgtggtgtgtttctacaccaatgagctcagtattttaacataaactgtataaaaataactgctagtatttatacttcaaaatgtatctatttagttgagtgtgatggtgttcacctataaccccagccactcgagaggatgagttggtaggagcacttgagtccaggatttcaaggctgcaatgagctcagacagcaccactgcactcccgcctgggtgacagtgtgagagcctgtctctaaaaagaaaaatcaaagtgtctgtatttctcatatttcatcacacttttggagtactgacttgtacatagatttctgaaaacgctttgtaagctgaacataagacaaaaagaagatgatgagaaccagccttatcttcttgaaaataattacgaagctataaaaagaaacagatacaactagacaaggaaccttaagggtcggggaggggaggaaatacttggatgccctctcttccttctggtcctcttctatgtgtattgattgcctcagacaccttcagagtaatcatattgtggagagcatggatgaacatctaagagggagaaaatatcaggatattaagtaaaactaggttttcaaatgcaataaccactcactgtagcttttcggggatgatatttgcctggcaataacttttgatttaagaaaaatctttttcaccaaaacctatcccttctctgagatgggttccaatctagataaatggcaaagctattctcctgtttactcaagacccaaacctagatgttactgttgatccctttctctcccttacctactatagccaatcaatcaccaatttctgctgagtctactcccaaatatttcttgagtctttccatttctttccaatctgttactatcactgtagtctgaaccaatattatcttttacctagaccatttatttactccaaagtaatttctatcactatcgaccaccaaataagtgtggaagttaacagtgccagctttcaagtcagactgctcactggttagctaagcaatattaggcaatttttaaagctttttgtaagatgaagataataatatttaccttgttaccagcagcaaatgggtctgcagcactcaatacttgcctaactggaggaaaaaatttggctgagggccagaagtaggttgaaggcaaagggagagataaaggcaagtttgtttttttgttttgttttttgtttcttgttttggagacggggtctcactctgtcactcaggctggagtgcagtagtgcaatctctcagctcactacaatctctgtctcctgggttcaagcaattctcctgcctcagtctcccaagtagctggggctacaagcacatgccaccacacacagctaattgtgtgtgtgtgtgtgtgtgtgtgtgtgtgtgtgtgtgtgtgtgtttagtagagatggggtttcaccatgttggccaggctggtcacaaactcctgaccttaagtgatccacccacctcggcctctcaaaatgctggagttacaggtgtgagccaccgcgtccagcctaaagcaagtttaagagcaggagtgaaagtttattaaaaagttttacagcaggaatgaaagcaagtcaagtacactaggaagagggtcaagcaggcaacttgagaaatccaagttccccatctggcccttgacttgaggtttcatacattggcattcatctagggtttgcatttcttctcccttgattcttcccttggagcaggctgtccacatgcacaggggcctggtagtacttaggaggggctgcatggtcagtgtgtttactgaagttgtgcaggtgctcatttgaagcatttttcccttaccagtagagtgttccagagaaaggtcatataccagttaaactgcatcattttgtcttttactgtgcatgcctgaacccacttgctcaagtcctgagatcttatcaggaagctgctaatcaccagcttcaggtgttttctgtctattgggagactggtgttggctgtggccaattattgttttagcaagacagattaacaaccacttgatcatcacctgatggtcacctgacattccagatggggggccctctcctgtcctgctcgagtatgcctacctaggtactctagcatttctgccctcaagagtacaagactcaattatttggtataatggatgaaagtcagtcttttgtggtagtatgttctgtgagtcttggtctcttgctagctgtcagggaaaagtggctccatgggttggtgaaagtggtatccagctaggtccaagggagaagggcaggaattccactctgttgtgtttctctgatgggcattctagggtcttctaaaaggatgcctcttgaatattgagaggacagtatccctcattgaggattatttggaatttgatggcctgaaggcaagaggagacaaattgggttattgtgcttagaagacatgtacctgtaccaaaaagactaacaagtgggcctaaaaagggaaaatcccaggagaaccatttccaggtttcttcccaatttagccagttctgagtgtcttgttctcataaactggaagttcaatttaaaagttgtctgatgtggtcttgtacttttcccaattgatttaccccaaagcaacatttttcatctgagtctaaacagatttctccctgtgctgccagtaacatatctaggtcttgacaattttggaggactatggctgctaaagagtcaatttgttgttgcatagttgttaaagttttatccatgtcatcagtgttgctgggtatttcctttgagagttggctacaggccaaggaggcttttgtgattccagcaattccagtacccataccagctataatgccaagtcctatgagaaggggggttaattggatagacctcctcatcctgggaaggatggaatgcctctggattggtgctggaagagagagactcctggggatttgaagatgtcagggatacataggctatggtacaagttccagactagttagtcagaagacattggggaactgattggacacaaatatagaaggttccttggacttaaagacaaggagccttctatatttgtggagagggtagagatgtcaaaacacaataaagtctgaccctttctagcatagctagggggcatgcctaactctgtatgttcccatgccttgcctagaatttaatggatttaaagcaggcaagcagtacagttactaagagtcacagtagcagtttatactactaaagcatttagtagacctaataacctttacaattttacatttttttaaataaattccctttcacaatttgtttatgacttacataggtcacctacaacatacttggatgatttgacttgtcctaaacatccctctttgtaaacaactagtcattttactttaggacaagaatgtaccatgcaagatcacttctcatataaaatctattttctttataacctttcttaccaaaaaatctctttacctttataacctttgaattagactaaagtaattttccttctgttaagaagttatgttgctgtgcaagtactacgaagagggagaagataaggagattatctgaatactttagaagttattctccctcaagggattgctcagttagatttcttactagggcttctctgagtaaacatggactatttctaaacccttgaggtaggactatccaggttgaagttaaagatttaggtaactttcccaggagaaatagggctactagagggaaagattaattcagagtttgggtagatattaagcaggcacccatcccaaaggggtgtggggcttttagacattacctggtacttatgtaagaatagtaattggcccctaagtaatataaaggtgtgtgaatcttttcttttcgagggaagtgataccattttcccccattacccaacaggatttggaggagagttgcttagagaaggagattagcacagactaggcagctctcgaacccaaaagagaaatttataactacttcctgcctccagagttgcccttggctttgtcctgttgatggccagcaatgtctgatctgggagctagctggagctggaaccccttcagtttaaggcctttattggattggagcctggcccaggggcatttttggctcttggaacatcctttttccagtggctgagcttgtggcagagggggcaggctatgtgggggtttctcccatttggcccatttgggcaattctttttccagtggtctggtcttctgcaccaatggtagttatctagaggagtgtccttacagcaacctggagggggctggtgggcttgcagagcagccagtagttaagactccctcctgtttgtgcatttctccttctccttagccctgtcctccttattctgctctaggttttgaaagactgaggaggctaatttgagtatttcttgtataggggcactgggtcctgaggctgacttttgtaattttctaccagatcatttttaggctgaacagtattacaaaggaaaactagatttttgctttaagatttggggggatcaaaattttcccaggtttgggtatgcatcgaagggtcatgtcctgtggtgtgcagacgcaattaactatatgtgcagaaagaacaaaggagagaagaaaatgaagacatcctttctagttttcctaacatctttttcctgcacttatggcagactggagtgaacagagtgttccccattcatcctaggggttccagaatgaaccagtgcttactgggtacccataaccttggtcccatcttgttttatgaaggtacaattaaccatttgtgaagatacaacacatgagagaagagaagaggagggcaccctcccacccctgtttttccctgaatcctttgcctgtggcagatcagagtgaacagggtttcccccattcatccaaggggctctggaatgaactagtgcttgctgggtacccctaaccttggtcccatccaatttctgggaccagccttcatctctgtcctacaggtactttggtctcttatgcctgtggccttgggccagcctatatctttgttgccaagaccttacagtgactcttgttcagagcattctagaagttacaagagctggcagagccagaggtccaattagtgtgtgtcctggcaatgagccgagacacatctatgagaaagcccatttctttgttgccacacaatgcagcaaaagctgtggacatataaataacaaactgggaatgtggtcctgaaggagcacaagaccatttcagaatacagacagacaaaacaggagaataggcagtgcaggttttcaggaaacaagcagaggaaaccttgaacattacacggccttaggctttagccctaccactctcaggagcctcctgtccaagagggccattagtgcctcaggtctactctgtgcagactccaaggtccttcccaaccccatgagtcactcatcagggggagctgtgagatcagctgagaacaaagccactgtgaccaagaggaatcattctgggcattggttagtaagcaggagagtgaaaggggagaaagaatccatgtacaggggttgtacgccctcagccaaagaaagcaaggcatagaggtgtcttaccactagggaatgtgcctgagtcacagcaccaatgtatattaccagcagcaaatccatatggatctgcagcaaatcaatccttgcctccttggaggaaagaatttagccaaggggcagaagtaggttgaaggcagagggagagaccaagacaagttgtagcgggaccaaaagtttattaaaaagttttatagcaggaatgaaaggaagtcaagtacacttggaagagggccaagtaggtgacttgagagatcctagttccctgtctgtcccttgatttgaggtttcaaatactggcatggttctgggatttgtgtttcttctccatttattcttcccttggggtggcctgttcacatgctcagtggcctgctagcacttgggaggggtcacatttgcagtgcagttactgaagtagtgcaaatgctcatttgaggcatttttcccttatcaatcaactgttcctaaaggaagatcatttactggttaaactccaccgtttttcctcttggtgcacatatttgagcccggtcatccaaatcctgagagcttatcaggaagcggctgatgacagattcagctcttttctatctgctaggagaccgtcttttcctggtgtcagctgagaccaattattattttagagagacagtttaacaatcacctgaccatcacctgatggttgcctaacattcctggggcagccctctcctgctgtgctcatgtctccctaactatctactccaacaacctcactgggttgttttaaatattaatgtgttaatagacgtttgccccaaaagaagcctgctgaacaggaagatagtcagcaaatattagccattattttattaccgcacccaacaggcccagttatatcagttatatataaaatgcctgtctgattatgccttttttttttttttagacaaagtctcactctgtcactcaggctggagtgcagtagcctaatcatggctcattgaatcctcaacctcccaggctcaatcttccaactgcagcctcctgagtagctgggactacaagcataccaccacacctggctaattttcttattcttatgtaaaagtggggctcttgccatcttgcccaggctgctcacaaactcctagactcaagcgatcctcctgcctccatctcccaaagtgctggattgcaggcataagccatcatgctcagcctgactatgcccttttcaagcttaagaccattcaatgacttcctattatttttggaataaattccaaaattattgacatagctccacgtgagcattcttgattcacctctgcacacctctccagccatatctttgctattcactgtctccctcattatctgatcttgagcagcagtggcttaatttacatttcttaggcacacaaggttcatttggcctaataaagcccctgcatggcagctctcttataccttccttggactagaatcccagttatcttcccttcactcctgatgtttcttcagaaaccaacttgaagaatactttctcagggccatttactatgtgacattattatgtgaccactcaagacaagatcaaatcccatgtttatgcaatttcctaatacctagaattatagccaattagttacttatgtaattatatgtctttgtttctatcatgtaaattttattacattaagtttgtaatgaaatgggaaatgtctgtttgttaaccaaggtatcactagtgtctaaaagagtacctgacatctagttaacgtttaacaaatagttacagttatagaataaacccattataaataaatgaactaaaaaaataactgtggagttactctgattctgttctttgactttctagggattaatgctggatctacttagcaagaggacagccagggacaccttagagataattcatcctaaccactccttttacaaataaaaccagactccatgcagctataaaaagagcctttctcaaccttcctccagtcataagttcttttgtttctctatctaccataactgtgaaaggaattccatactttaactcgggcattagtggtgattagttgtccaattcataaagttgtgcattgctgaaaggggtaatccaaaggtctagaattcaaatgtcagaagtaatgagatcagtaaaatacaaggataaaaaaggcttgagaccacaaaaaagtatttcttctatctcatcttgtaaaaatcatctctgagtataaaatataacatgatgtatatttttaaagatttctcaaatgaactctaaacaggaaaagacaaaattaaggatagaaacttggatcttggttggtgctgtaaaacttgagaaagttatttatttttgttcttttccctatgagggaaaatggtatttccaatttcaagaaatccaaacatatataagctttgaaatcagaaaaattagaagccaattataccatttttaaagtattttctttgcttcctcaaatagtgagccacctaagttcaatagatcataatggcttttttttttttttttttttgagacagagtcctcgctctgtcgcccaggctggagtgcagtggcatgatcttggcttacggcaagcgcctcctcccgggttcacgccattctcctgcctcagcctcctgagtagctgggactacaggtgccctccaccacacagggctaattttcttttttttttctgtatttctaatagagaccgggtttcaccacgttagccaggatagtcttgatctcttgacctcttgattcgccctccttggcctcccaaagtgctgggattaaaggtgcaaggcaccgcgcccagcccataatacctttttaaacatgtatttaaattagatttttaccaagccatattaccaggctaagtaaaaaggtacctgtttcataattgagatcgtgtatatatttccaaaatgaccaaatacatacttttattgaaagcaacccatattttgaatacctttatcttatataattttgttctagtctacaccatcattgctactgacaaaaattatatagtactttattgtactcaagtttgttttgtcttgttttgagacagggcctcactctgttgaccaggctggaatgcaaaggtgtgatcttggctcactgcaacctctgcctccagggcttaagctatcctcttgcctcagccttccaagtagctgggactactggctaattttttgtatttttttgtatagacaggatttcaccacatcgcccagcctggtcttgaacccctaggctcaagcaatccacccgcctcagcctcccaaagggccaatattacaagcgtgagccactgcacctggccacatttcaagatattttgtattttctattcttgaacagtcttgactgaacatgaatgctctctttctgtccacccggagtagttgaaagatatttatttaaaagtgatattaatgatataaatagataaaagaagagtatcacctggataagaatttggaaataagagaaaagtttacatttgaaatgcaggttttacatgaaatatatatataatcggagttgttttttacagtgaagttcaactgttctttttgttcttgctgttccgatgctctctctcttgtttctttttgagtgtcacagacatttatattcctcttttctcaacctaacctttccctgattacaggcatttgtactaattactgtgattccacagttcaacacagacagctttgttcccactgctacagaagcacagagctgcatcaatattgagtagggggttcttgaaaataacctaagtggcattttggaatagatattcctccaatgggtaagatacctacctaaaaccacaaaatatacattcaatagcatatttttttgaaattctatagactttccaaacaacttggtttagaataaaagattcataatatgctaacacaaatgtaaatattgtaccaggtcacacctaaaggatggaaaagtctagtaagtgaaaatgcccattactcttgggctgtaagattttctaccagagaggttgcacagtaatataccctaactgttaagaatgagaaagtttgttgctgttgtattttgttttattttgtgggcatctgtaagaactagagaaaaactgtagagtcctgtgtgtgttttgtttcacctatggaatactgattctcttcgtgttaaaatgattaattcttatttgttataaaatagagaatattatataagttctggattcctgtattctcttgaaaatcatgaagttctgccaactctgggcccaatttcatctagcagctactgctgcagtatggtgcttagactcacagagggaggtggctttccagttcagccccaaccccacctctgtctttgcctaccatacactgaaacctagagtcagatggcatttatcattttttccctaatattagagttgaaaatatattttgtaaatatctgtgtttctatcaagatgggtaagattaaaaatggacccgaatagctgtatgattcaaataaaagaggtgtagtccaaaaagaaagaatatttctttgtggaaacaagggacattccacatatttaatttgtaatgttgtctgtgtgaaagactacatctttgtcatctgtgcattctactttactatacacatttatatttatttacttgccccttagtagcttagtctacagccactgtgactgtcatattcagccatggtgtaagctgacatttttttaaatgggtgtgtgaacatgtgtacacttcggaaaaagtggcaaaggatatactccctatgtcaactcattatacctagttcatgcgtttatcagttattttaactttcttttgtttatctttttcatgttatgagttttgaccatgtgcttgtgttagatttaaaaacagaaaaacaataaaataaaatgaaaaaagtaagaaaatggtttgttcagaatgctaaacacatattccctttttgttcccctctggatgcaattaatgcatacttcaatcttcatagaacctaatccaaaatgcaagggtctttataatcagccttcccaaattgatttttactcaatcaaaaccctcctctccagacatattgatttttttcattgtcccttaaacacacctgaactcggaaccatttcctccttcacgtctgtatttattctgttaagcctcttgacttccctcccagcccagaatatcttattttgttgatgcatcaaaatactcacatcattcaagtccagttcaaactccttattaatgcttcccttagacgccggaagtgatcgctgttctccctaattgcaattgcacttaaaccaactgtagcgaacagctcaatctttgttaaatatttcctcataattcctctgaggagcactaagaccctgagatattgatagtttttgtgatataaaaatttccatggcttaaaaaataatgcaaaaatgttcagaaacatttggtttaaacaaaattaaccagatttatttactgcagtatttctcagaccattagaacatgtgtagtctcctgctaatagtgaagagtggttttaatataaggaattttacaaaattttgtcagcatcaaactgacaattgtccttatgattttgtccatattttctagtagaataatgtcctgcagaagataatttgggtgatcccagttcataatatagttttatgtgtatctctttatttcaaaccagctagcaaatttctagtcactgaacttgttcttacaaatatttttacacgtcgagatccttcaacacttatgagttcatggtatgtgtgcaaaaaccacgaatagataaggaggggagtaacaatacattgtccattggctaagataccggagcagttcaaggggacagtcatcccagattcagggaaacaggaggaaacccatcaaaggatattaggtaacctctgacagtctggcaatgtttccctcttcatgacactcggtccttgcttctcctcttctgtctggaccaaatgatttcaaactcaggcttcctgtagctctccagtgtgaaagaggcttaaagagataggatcacttcaattcagggtgcagcctcatttttccctctgctgttcacatattgataggaactttacatctgtcatgtctccttttatagatgaatgtagggagggtggatgataatgcattccaatatttattcaatttcaaaatgaaagacaagttgaaaatccttcatgaggatgcaatccacggaaatatgagagctgtctacctaccatctctaacagattttggcctttgtttatttccgaagcacttatttgtcattaagataatttttgtttatgttttctcaggcatattatgattcccttaagtttccagagagccttgttctatgctctgtaaaggagaggcatatgtgggttaaataagaatttaatatatgcttaatgaatatatcacttatttgtagaatgcattcttgttcctccttgatattcttgccatgccaaaccatcacgatttctgtcatttgccaaagtatattcttactttgcacttacactgattacacctgatagcccattttgctgagtcatcctactgttctctgtgtccttacttctcatagtgttgtcaggaaaccagcagcataggcatcccctgagagtttgatagaatgcaaaattgcagctccaactccagacatagtgattcagaatacgcatttaaacaaaagtccttggcaattcttatgctcattagagttggagaagctctgttctaagtgttccctggatttttcactgtgggctgaggcacgtggtatatagacatctctctctctcttaacttcttctgttctcctgggcattgtcttcaatatttctctttctttttcctttcagcaagtgcacctgcttaggactcactaaaccattttcacaattaattttccatctaatcaaaaccctcctatccatatatctctactatcactccaaaaataaaagtttcattgaggtctgcctcccctatagttagctagctcagatggaagttgtaggctattccacttgccaggcatttttcagcccattgtttgcatttttgttccatcattttcctgaaactttttaagtcacaattacctaaaattgttgaacatattgagcattttttgaatttcagttgtctggtctctctgtcacctttgacactgttgttacgttcttccttaaaactctctttttcctcagcttctgagaaataatcctcttccgattccacagagactcagatggttctttctcatttccccacatctgtgttcccatccaatcggtattatccttccatccatgcatccatccatgcatccatccatccatctatccatccatccatccatccatccatccatccatccatccattcatcttcagctttctttttttaatctctctatacattttttataaatgatgcttctgactttcaagacttcaactaccagatccagagctactgattcctttcatcagtgaccatgccttttctcccacatgcctctctgaatgtgagatatctctccctgtcaatacaacccacactaaacttattttctccccacctcttccattctatattccttagctgggctggtagaattgaaaagtctttctcaactcctacttccttttctgtgcacatccaattatcccctgcattctgtcaattccactgtcttaacaactcttaagtctatcttgccttcctatcacatagttaccaacttaattcagaatttcttcattatttcttaccttcactgcaataatggtctcctagtaggttttctttctccttacccacagagttcttcctaatcaatttttcttacttcttacaccatgaaaaagcttcccttctcattctgtagccatctcaatgggtttgttcttgcaggtctaccaaaagcaaggaagggctcctgaggttataccaatgtaaaaggatagaaaggtgagtaattcagatgagatgtggtttctcagacaacactcccttccaacatctatgaaaatagatgaacatgaagcaaaattaaaataatagcaaatagtctgggcacaatggctcatgcctgtaatccccgaactttgggaggccaaggcaggagcattacttgattccaggagttcaagacaagcctgggcaaaatggcgagaccctgtctctacaaaattaaaaaattagccaggcatattgatatgtgtctgtggtcccagctacttgggaggctgaggtaggaggattgcttgagtccgggaggtcaaggctgcagtgagccctgattgagccactgtgcacctgcctgggccataaagcaaaaccctgtctcaaaaagtaacaagaagaagaagggtagcaaataaatagcaaaaatatagcaaaaaaagaaaatatagcagtccataaaaataaaagttcaaattgattctgaataaaaaacatgctttcaaatccatctgaagaattcctaccttagctactgatttgttatcagaaaaaacaaacactgtgaaatatttaaagaggtttattccaagctaatatgagtgaccatggcctggggaacagtctcaagagatcctgaggcctacaggtatcctgaggtggattcaaagattttctgggctgggcatggtggcttacatttgtaataccagcactttgagaagccaaggtgggcagatcacctgaggtcaggagttcgaggtcagccgggccaacatggtgaaaccctgtctctactaaaaaaaaaaaaaatacaaaaattagccgatcatggtggcacaatcccagctactctggaggctggggcaggataattgcttaaatccaggaggtggaggttacagtgagccaagattgtgccactgcactccagtctgggcgacagagtggcgccatctcaaaataataataataataataatttctgatttggaatttgttgtaagagttaagctttatctttagactggaagtctttgtctaaagacttgaagttagtaggcagaaatgctcaagttaagattgggggtgttgtgatgaccaaggtttctgttatgtagatgaagcctcaggagttgcagtccttacagagaatagatggtaaatgtgtcttttgggaacttgaaagttttcagactcttacttaatcttttctagatctgaaaaaggtctggaaagggaaggcctggccgcattaatggagattctctactgatgcaaatttcccccacaaaagacagctttgctgtcatttcaaaatatgtcaaagaaatatattttatggtaaaatattttatttccttcgggatgtgctttctgtcatttctgtcatgtgatgttatactagaatcaggttggaatttagcattttattgccacaaggattcttttttgtcagtcttaggatctctgttttaactttaatgcctgtcacttatgcctaagctccaaaagggaggggatataatgaggtgtgtccaacctcccttccagttacggctggaaattcaggttttcaggtctttctagggtccccttggccagaagtttgtcagttcagccagttggcggaactgaaaattttacttacggtttacagactttagaaataaaccccactaattgcccatcctattttgagatggttcattcatatatgaaaaactcctgttcctttacatcttgatttatacctaaaaactctgtgcaggtatgatttctgtcattccagaattctccatgcctacaagtagtgttagaaatttcctttttgcaaaactacttcttctgaaggagagtgttggaagctatcttatagtttggattcatgggctggggtttggaaaagagaattattccagggggttatgaagaatcctaaaatcttaacagagcaaaatctcccaatctatatatatgtatatgtatgtgtgtgtgtgtgtgtgtgtgtgtgtgtgtatatatatatatatatatatatatatatatagtttttttttttttttcttgagacagagtcccattctgtcacccaggctggagtgcagtggtgaaatctcggatttgccattgcattacagcctgggtgacaagagcaaaactccgtctaaaacaaaaagcaaaaaacaacaacaacaataacaaaaacaaattggccaggaacatttctgtttaggaaatttaagaccaaggaactgaactaacattgggtacttaccagagtctaagacctgttattcatgggcatttagataagttttctcatttaatgtttataacaactctattgataaggacatgttctcaatagagaaaaatgaggaaagataaatgaaaataacaatggagtacttaatgccaaaaactttatcaggcgtcgtgaggtatctattatataaagctcattttgcagatgaggaatgctgctctgagaagatgagtgagctgctcatggaaacgcagctcttaactgctaaagggaggaagtaaagctttgcctgctttacttcaaggcccgagctgttttcattataacaatctacagtctttaagataggtgaagaccattttggacgcaaatgagctaaactgcttatctatttgtgttttaatcaggtctgtctgtgaagttatcttccagctattttgtattcaccccacgatacctagcactgtgttctaccatacatgaccatcaataaatgtttgctaaattgatggatgggccttgctgtgctattaaggaacactcatcacgctacaggaattgctttgtccccacgttaacagacaactggttatgatgaacttctaaaggaaaataaaattatgcttctctgaaaacacatctaataaaatgaggatgttattatcatttggtttgtttttgagaatatcgatcttaaatacagttaaataaatagctggaagattggaaataacattaggaaaaagatcttttatgagacatgataaagaacaataattctttcatatatacatttaagtacaaattcacagaactccttctgaagaaacaattgattcactcctaagtttaagtacctattaaatatttcctagtaggaggtttcatctatatgttacatgtcagtagcattacgtcaaataagagtaactatttggacccattctttggggttgaggaatggaggtgatagttattatgcatgaagtggctgactggatggtgcacgtcgtagactgcctaatgttgatattcaaaacaatcatatgaaatatgtgttactataatcacatttagatgggaaaactgagtgaggaggaagtcaggtatgtttcctggcttacatgtctagtacatgataaagccagaatttaaatctgtatgtctgattccaaaatctttgtccactctgcttctcccatgctacctccaatagctcaaagtatgaagaaggtacagtgacgcaaatagggccttcatctaaaaagatcagagtaatagcataatggataataaaatatttacaatatcaacagggtcaggggtaagtgcatttgtagaaaaaaaaatgactggaaggaaacaccacaatgaaaacagtggtttcgttgtattatattacgttttgctattttagtaatggaaaattttaagctcatgaaaaagcaagataagtgtattttaggacaaggctttacatcagattaaagaagatttctgggagagaatcagcaagaggccatcgtgcagcctggacagagggagggaacgttccacactgctgctctaacagaacacaagcaatggcatatggcactaatttgtgaaattacactttaatttcaaacccaggttaggaagagtagtcatggctggagaacactgaagaaggcttccacctattagctcaaacagtcaggcaggtactaaactgatccagcaggcagcatgctagatgttggagatagagagttgaacaccgtcatgtacgtaaaaacagcatattgtaggagcatactttagggttgtacttctttatagatcctctgaagtggggcccttgagatatatatatatatatatatgagcaaatagaacataatagcttttctacttccttctgcattgctttttaaccttccttccttcctaatatgtgcatcctgcctcaattccctatctaccttcttgcatactggcccaatatagagaatatattaattattactttccttataatagcacctcacccatctgttttatccagaaacccagttttacattccattttcaaggtcagcgaaaaacagagaaggcctcagcattatgagtgctgccccatgagatagtaggtagaatggcccatctgttaaaacactgttcataattttaaatggaacattttaaagctcagtgaaatcatttctactctccagtacaatgaacttctattctcttacctcctggagaggttgaactgaacatggaaaatcgggcctttttggttcttgtagtgaatataaatggtgatatcaaatcaccaacttggcccaggagataatttcttgtgagtcgctgaggctggctgttcaatcttacatgttttacacataattccagaccattttgcagaaggtttcttggcttccatcttaaggatcaaaagcaagtttcctcatggtttgtgattctcatgccaaaagggtaaatgtgcaggaaggtcataagcagtagcaaagcttctctcacatctgccttgagcttgagcagtcaggcttgctaatttgacctcctattgtcatttagaatcttctgccaggagagtttttttcttttttaaagaagtgagaggcagataatttgtttaaattatttatatttaagaagtggaaggaacagggaagaaaaaagagatgtcttgattttctgaggagtatgccatggatagacacttagggcacaaaacagcagctacctggtttatgctgaaaaaaaaaacaaacatgtaaatagcaattattgtgcagcagtagccctgaggaggattctctgcatactcaatctttctaagcacccctaagtgtcttggactctccattacagaaaatgtgtttaggtctatgaatggaagagcgcacctgtgtgtgtcctgtcccagtgtttctgtgatgatgtggatgtcctatgaaaatattagtaacagatggcaatgtttctctagccttgatgttattctcatagtatttacaggtcgcatcaactggtcagatgtggctacaaagtaaagtcataatacttcaaaaattattcttcttgaaagctcatgtatatgtattctcaaaagacacactcaggcagttagaaccagtgtatttctatgtaatgacctgttctcccaaacatggttgtctcattgcccagggattaaaaggggaaatgcttctaacaatcagcaaaggcaaaaactgcaaagggatggaataaaaaaaaaaccataaagcagacataatgatttacagaggcaagcaatctgaggttatctatttgaggagccaataattacatgtatacaaataatctttggaggaatagtacaaaaatggatgtttcagaggttgacccaagtcataatatttaaaatccctagtgtaaggaggcacagagcaatataattttagaaaatcacccatccaaaatatattttaaaggattttcacctaaagatgacattccttttaccaatgatgtagactacattagttctccttccctttaggtctgaagttcagttagctcagtctcttttgtactaggtagagtttgtggctattcccttgaatagtccagatgactttgctcttaacaaggcagtcccagagtagttaacatgaaagccacgtgtgagggtgtgtgtgggagggagagaggagttggtgggaagaggaggtcatctgtgctaatggaaaataaactcaaagggcatatccagcatcacctttgtatgggaagagcatctatttggggttttcattttctgataggcagtgatagaattacaactaatataataaataaatagaactttagagagtgcaagaaaagaatcccagccctggccagtgatttgatttgctctagcacatccatctgactgagccatctggcagtgaaccagtggtatcagaacagcaatgggtgtaaccttgaggaagggttgccccttgacaaacagactggtgggaaaagtgcaggatgtggcaagactgaggatgaacaactatccaccctgcagaggatagcgacatagggagagaaatgcgtggtgcacatcactttgtcctgagtgtttggccaggccaggtatgaaaggcacttaggctggatacctaggaatgtctaacagcaggtggagcaggcaagaaaggaggccaggctctagttaagaagagattaattatggtttggagagagctgtccattcataactggcgggctacagagggcagaaatcattccccaatgggagaaattgttaagagattgagtgaactccaactatgaaggcctatcaacggacagaaggcagggcgtagagaatgttgtgatttagaagttatacagccaagtaccttctaggtacacctgtgctgtcagactattagaacaagagccaattcaaagttctattcaactttgagacttaggctgccagtattcccaccaggtcacatttggctaagacagctttacacagagaaatgaaggtcatcagcataaagacagagatgttcagagcttaaggaggaaaagtagacaatatcatatgaggacagaaagaggcacggggatgcataacactgtattaagatgaatattacaaagctgaaacaaagagtttttaaattctaatttgcatttccaaaagttatatgcacagatacttgcactgcttcatttcctctctacatgggggtctgggtggctatctggaagaaaagaaaaaagcttatcaattttttttttagtgccctattgaacacatcactgcattttaatctgggacagatggtggaaaatggcatctggttaatcaggggttcatagattatttggtgatacaacttaactgtgctgatgaagaaatgagaaattttgtctcttccctagagcagcattataaagcatccttcctggtgtttaaaattgattgtgcattctattggttaaagagtggcattttgaaaataaaattagggctgatttgcatttgtgttgaaacagttgcacaggcatttgataagaatagttcttttttcttttagaacacatttacagtttgcatttatttatattaactcaatgttttattcaacattgttttaaaagacaagacaaacatggatataattactcataaagaaaataactcttatgagtgagaatgattactatgtatttcatttgggaaaataaaacacaattttttttattaataaggacacaggcaatacttcagtaaatgtaccaaggtaattcaattttataacggacaattttaaaaggcattttgaaacattatatattattaatttttacatctagaattgtacttgtagatgccatcagaatactcgatcaatatctgtttattcagatttaagctccatgacttagttgcattacatttaatttatgtgtatttccttgattcacagtctgtagtaaattctgattgcttacacctgggcaaaatgtctttaaaattgtcaataacttccaggcagtaaaaaaaatgaattgcatgttgatggtaaaagaaaacaaactgctacatgtgatgcatgcagatttattaactaaataagtcttcattcctcctccaagtatgattgaaatttatagtcttgctagaaaactctattttccaagaaagtgtttgcaaagacatttgtacagtaattaaaatagttacttttccagtaattataatagggaacttggaaatatgcaaaataataatcttattttatttatggtatatcatattatctttgaaaagcaactcaggtgacatgatgtttaaaagttttaatctcctaaatgaaaaatatgttgctattgtagaattggtcttgtaagatggtgtcagagacaaaaatcataggaaagttcatagatttttttaatttttaagttatttcacgtaaatcatcaatggactctaggaagacataatccctcccacccctaccacacacacatacgaaaaactttacattttaaaaggccaggcaaatactactgagacagagaaatatatagtaagcacctggttgtaaatttaaccataaccatccagaaagatcagttataaaatggacattctgggctgagtatcaatggttacataaattgaactttgtcaggaaagggagggaactgagtttctaagtgggccagaggtgaaaagcaggttttgtgaaacacctagggatgctgcagttgaatagcctgcaattggaaggtagatctaagaagtaaaaatactaaaaaaaaaaaaaaaaaaaaaaaaaaaaaattaagatactactttgttataaaataccttgacgattctgtgctgatgatacatgaatcagcctcctcccatcagtacagtgaacttggtcaatgaactgactctaatgtgtgcttctttgccccaaacagtcatagggcagaaggtctaagctttagaagttgaatcctatgggagagggcatagcattcatgtaccatgacagacacatgttcattctctgccccataaggggcaaacaccattctgggtacttagggcatgaacgtgaaaaaaatagaccaaagttttgaggtgtggggtatatattacaagaagagaagagagagcacaaacatataaacaaataaataaacatgttccagatggcaataaattttataaaaataacaaaacagggtagggaggatagaaaatacaaggatgctattttagagaaggtgatcaggaaagatcttccaggcacagtgacatttgacagagatgtagaggaagtaaaccatgagctatgtggatgttctagggaagtgtactactggcaaaggaaacagcaggaacagctcggagagtttctgtttaaggaccagcaaggcaggcagcaagtgaggctgcagggctgtgggcagaaggaggatgatggaagatgatggctcagagctggtgataacaaagaggcgagatcaatcagaaccttttggccgctctaggaaacttggcttttcttttcactgaggcaagaggccactggacatttttgagtagagtgatgtgatctggtttctcttttaaatagcttattttagctactctgaggaaactgaaaagaaggaagacaacaacaagctgttgcaacaattcagaccaagggtgctaagagtttggaccacattgctaacaacagtagtgagaaatcagtgcctattctgatgtgagtcaatgggatttgctgatagactgggggtagtgtgtgataggagagagaagtgaagagaagtaatccatgacgccaagttttctgatccacataattaaaaggatggagctaccatttactgaaatggagttgataatgggaaaaaagtaaatctgaagtccatttgggggccataattattttgagatacttcttagctattcgtggacagatcaaaagatgtgacatgcttatcttgaaaaaaaaaaaaaaactaaagaatgaatgaactagaggaatatggtaagattaccagataggcctaaaaatcaccagagtttgtgaatttcctccagtggattaaaaactccaccagaaataagaacaattgagttagagcaagaaggtagggatgtttggtgaagtggttaaggtttggaaaaatacttagaaatattttatcttctaaacattataggggtagggatgttatggccaactgtgtggcttggaaaagttccttaattaattctcattgcttctactcagtacgcagttcttataaatcagagagaacatctctttcaggttgtatcaggagcattctcaaactaacactcataaatcggcaatttaggcagggaggaaaggaatattcaccgattacctgctatattccagacaccgtgcatgccgcttcacacatattatcttaattgatcttcccgacacattttcgatgtggaaactcttattttcattttagaggtgaataaaggttaaaggttaaagattcacctacttaacatagctgggcagggatagagcatggaatttgccttacctgccatcatttccatctgaagaagttgaaaagctgtctccaaatattttggtatgagatggggtacataaatacttgttaataacttgttcgactgcattatgtctagacaagaatatattaaattcggaaaagaaataattttaggagtgtaagctttatgaggatttagtccatgctgtcttatatacaggtgtattctattcattcactcacctaatattcatttggtgcttacaataggaaaggaggttttttgtttatttgtgtttgcctgtttgagatggagtctcgctctgtcacccaggctggagtgcagtggctcaacgtcagctcactgcaacatccacctccctgtttcaagcaattcttgtgcctcagcctcccgtgtaggggggactacaggtgcgcgccactatgcctgcctaatttttgtatttttggtagagacaggctttcgccaggtaggccaggctggtctcaaactcctgtcctcaagtgatccacccacctcagcctctcaaagtcctgggatcagaggcatgagccagcacgtggggctaggctaggagttatgtgctccatagttaaataagatacagttcttgttcttgagaatttcctattttatatatatagacagccagataatagcacactgtttctactttaaaggctgcactcctcttgcctgtttaatattcaactgcctataatccagggctttgcaaaaaatcattcactgcttttttgcagtgatcagttaatcaagcagagccacaaagggactcaagcaagggtagtagaaggctggcttctggaatacaggaaaagcctctgtttgccagagcccaaggttttaaatacagacaaagtcaaaggctgggaagaaagcaatgtgcgctcatagatagcatggacccaggagatcagccccagggatggagatcagatggaagccaacattgctggtctaaatagaggcagaccaagtttagaaattgaagcacagaagttcaactgtttcaaagagatttactgcagctttgaaaaacacgaactgaaaatcaggggtgagtgtggcagggcccacaagctctcaaagaaagagagggaagcgctaactgggcagcttctttggcttcttaggctttagacccttctgaagatgctgtatatctttctctatcaggacccagggaagttgggttgttccctgggaatacttactgctgcaccaggaggaagagacagctacagtgccctaagtccccagctccagtagcccttaaggatccctggtctacttcagctcctctttcgaagctgcctcactctgagtagttttttctccctctaagagaggcctattacccttgctgctgctgctggtggtggtgggggtgtcctagatttgtctagttgtttgagtttgggggctagatcttgtattggagttgaacttcaactttttttaaggggcaaggctcttgactgaaatttctttggtaaactcttgttcctagaaaaaatccagcatttggctccctttcattgaccttttcattctgtggatactaagcctcattgatctcccagctagattcacatgccttgggatattgcctggttctaggagggacagtaggtcatatcatgatagcagtggatgagcatggtgctgtgaggctggctgaagtggccctcgataaaggtcagaaacaataggcagaagggtacaccatttatacctactggtaaagtccattggtagcccatggctggacagaaaagcaatagcccctttcagaggatggaagttaaagtactagttataaaactaaagaaaatatttaggccactggaagtaatggttcattatgattattaaaacaacaatgacaacctgcaggctaaggatgtctttaagatattgtagaatgcctgagtagataaaatatgaggcaaaataaatggcagggaataaatggatctgataagtggatgacttactatccaagatgtagcataatttccacaaggctatattctaaaatatgcagttaatgccataagcacaaaagtataaaatgcactgggatctcaatatgccaaatgcactttagagtccagtgggcttgatcttgctgaggatggccatgcctcaacagattttagtctcctagaccttaggtcatttgtattatctgatagcataaaggtatgtggcatcatggaatgagctaagtaccacattggagaaatctccccggatacccaatgatccccaggacatttcattctgttcatatcccagtaccagcagaagacagagcaatctcagatgcagcctctgccaatctcgagattccttctgccagatctttatgtcatctcagaagaatagtattttttttttgtatccttgtcctagatccacttcacactgtgttaagcaaagtggctgagaaaatgcagagttatttcaggctgagacctatatcggataatcataagggctgtgtacaccataggatggaattcacttgctttatttttcaacatttaacacagtgaaagatttaaacataaattatttgattggctcactcacttacttgcaaggaagctcctgaatcactgtatgatccccatgctcccccaaccaattcctgaaacttggaaccgaagcattattttggaaacaccaatgcaacagaaatacatgctattaccctggggccagtacaccttattctgacccatgcttccctctctctaggattgctctccacggggaaatgtatcttgttctttggccattctcatgcagagacactgttccttccccatgtacctgttaggattcagaacaagaagtcacttaactctttttacgtcgaatagttaagagtacacaattattcaggaaattgtaactttgatgtatttaaatataagaagcatctgcttggaatctgacccacgtttgtagttcatgggtcaatcagaaaattaggcagggttttaaatgatgttttcactgctctgcaaggtgcaggctaaaacctttcctcttcactcataggtgggaattgaacaatgagaacacatggacacaggaaggggaacatcacattctggggactgttgtggggtggggggcggggggagggatagcattaggagatatacctaatgctaaatgacgagttaatgggtgcagcacaccagcatggcacatgtatatatatgtaactaacctgcacattgtgcacatgtaccctaaaacttaaagtataataataaaaaaataaaataaaataaaataaaaagaaagaactcacccagtgcagctcccttcttccaagtgttgactcttctccagaatttgcttgcttttgtctctcgccagtgccttcaggtggctgttttgtagtttttccagcatttatagttattttctttgggaagggcagtctgattgaagcttattcacacattttgaaggcatccctgaggaaacaggaagaaaaatttgcactgttaaccctttgccttgcgatcaaaaagtttgtaattattatatacatatcctttcttggctttgattcttttgtgatatgtgtgtcagaaaaaaaaaagaagaaataaaagaaaggcaagaagatgaatggaagaaagagataaaataaggcttttgattaatgtataatgacatatccacaattacagtatcaggcagaatagtttcctgttcctaaaagtttcccattctctgcctattcatcacttcctccctcctttcaaattcatgacaatcattcatccttctactgtctccatagttttgtcttttccagaatgtcacatatttggaattatgaagtatgtagccttttcagactgacttcttttacttagtaatatgcacttaggatttatcaatgcattttaatagcttcacagctcattttcttttagcactaaataatatttcgttgtatggatataccacactttattcatccattcatctcctgaagggcatcttggttgcttccaagttttggcaattataaatacagtgctgtaaacatctctgtgcaggtttttatgtggacatacgtttttaatttatttggataaacaccaagaagtgcaattgctggatcatacggtaagagtatatttagttttgtaagaactgtcaaaccaaatggtacagtggctgtaccattttgtgttcccaccagcaatgaatgagagtttcagttgctccacattcgtgtcagaatttagtgttatcattattttcaattttagcattctaccagatatgtagttgtatctcattgttgttttaattctcaattccctaatgacatatactattgagaatacccacaattttacaacatggtatactaccactgctgccattacttgcaaacacctagttaaaactttctatgtactaggcactatgcagagtacttttcatatattttctcataaccctacgagtcagatacaccattattatgcattttcaggaaaaaaatcctgaagttgagaagagttaagtacactgctagtaaatgttgaatctatgacgctggggtctttctgactccaaatctcatcttttaaccactacatacatttttcctcaaagtgtgatcccgaatcccatacttcaaaccaagcaggatggtgataaaaattcagaattctgaattgtaaaatattgcattagaatcttcatgctgggtgtggatctggagtgggagaaactgaaacacactcaagattaagagccattatactaccattctaggattactcgaagtccaagtagcagttttgatactttgtttctatcttgtatcatgtatttctctttgaagtatatttacaaaatccctgttatttatataaaataaattatactaaaaacattgagattatatcttaaatgtaggtgaatatatagttttctatgttccctaattaaggatgctataaaatcttttcctcatacactctaccttagagataaatttgacaacaggggaaaaaaaaaaaacaacctcgagtctttcaaatatctactatgtatcattctggtatagtctgattgtatcctcccaaaattcatattgattcagttgattcaattgaaatcataatcaccaagttgatgatattaggaggtggggtctttgagaggtgattaggtcataaaggcaaagccctgagtggaattactgttcttataaaaacactttagacaggtagcttgctccttcccacatatgaggacacagcaggtgccacctataaactagaaagtggaccctcgccagactccaaatgtgccagagacttgatcttagacttcacagcctgtagaactgtgagaaatcattttctgttttttataagccacccagtttatgacatttttgttataacagtgcatagggactaagatatactttgtgctaggtaaattgaacaaagatcataccaaatacttctagcattatgacagatttatctaactataaaagtctatttaatgtcgttttattggatggaaaaactgaatatatttgcatattttactatactatatatactatatatatgcatatatagtgtgtgtatatatatagtattgtatatatgctataccatagtataccataatatactacatatatagtatatttcacgataatttcaggctaaggaaaaagtcattattgcaggcactctatgaaaacttattaattaaaataaacagacatgtttttgttgtggcttttgatccaagacaagacattattaaggatattaacaatagaattgcctgtgttcaaatctctgctatgcttctaagtcattgtggaactttgggcaagctttagtaacaccttttaggtcttggtgtacaagattctaaatggagataaggaaagcctctacactctagaattattgaattaaaggagttagacagtgcctgattcacattatactttcaataaatgtgagctattattattttcattattattattctcaaaaacaaaaggaaattgagtaacagagtggtagagtggaaagcgtggcagaatggtagtgtgagacccaaaaatataagaatataaatgatatgtgacaaatccatagtgtagaaattgaatactctgagaatgaaaaactgaagaaatcacttttcatgggagtgggcagggatgcatggcttctttgaggaatctaaataaacttgaaaatgtttttaggtgaaaagaatgtgtatttggagtggatgtcctcagggatgtacaaatttagagactttagctctttttggtagatagggaaaccccgtttggaccctcagacacagcccactgtgtcaagacttggcaatttgaggagagatggtgtcaaggtaggtgctgtataagaaaggaatcttagacacatgaagagaagccatcctttcttgaaccccatttgcagctacaaaattgcagactgagtactacagtcttttaaacaagcctgtcactgagttcacaaaggcaagaggcattgtcacctgaagccacaaatcctgctaagagcattaattgttctctatataacataggctgtttagttctgcaatcaataagaaagagtgggctcagatcaggacctattgcttttcttcaggtaaacttggaattcaacaaatagaccacaatctacaattttctccataaggcagaatgcaggctaagttgatacatatttacaagcatggaaatgagttaatgaccttgagatgaggatctcagtgacataaacccccattctctttacaacttcttgagtttgtcttggtgtttgctaactctgaggaggtctaaaagaataaacagtgtctgcattctgctttcaatgccataaacacattttggagaggcaggagcaattttatagctgtacatacactggagagagagcatgaccctggagagctagaggtttatcatcactttaaaaaataatggttgagaaggaattgctctaagtgtagtctctgtcttttattttatattttttaatagctacctcttattgagtgtttactaagagacaagaactctattaggcactgtttaaacttttattttaaaatgaaacacagatacagcaaaccacacaaaattattataaggcaaataccatcttaaccgctacgcatgtcaaagaatgaaatcttgctagccatccagaagtctctatacattctctgtcctctctgtctccaaaaataaccaccctcttgactttcatattaatctttttttgcatttttattgtttaccatttaagtgaacatcctaaggcattataatgtcatcaattttcaaattgatatgtcttttagcttcaatatcatcaatgtgtcatctcccttgttcccacaaactcctttcccttaaaattaatctgttgacaaatatgggccacttgtggattttaccccagggtggatttgatgagtatattgatatactcatggtgccaatttacatgttcttctcttctctgcatttccagcaagtggcagcaggaaccttgatcaaactcagcttttatattgtttgcaacactataggtagcactgaatctttcatcaggaggcaaattgatgctcaacggcagttggttattttcttggtgattataaaatggtgatactctaattctatccattatttttacacattagctcaaataatttcatatgtaaggtaattcttcctttcacctacaatttggttacccaggggcataactccaaaaaggacagaactgaagtttttatgataggttttgtgataataaattggttccctatcatcctcatcaattaggatttaaatttatctgatggatcccaatgcactgtaatttttatccttattgaagtgctattttttccttcttcatccaggtggaggcttttcaaggttaacttttgattcctcttgaactagtagtctttgatacttcccatgttagttcataacaaaatgtttcagatttatctggtgtgctccttttcttatatctgtattcagcacttttctaagaaattctgttttgtttgtctgtttgtttgtttgtttgttttaacaccacaacctggttgcaagtgatagtcattgctactagggttgccaaagttagcacataaaaatacaagccacgtagtcacctacttgggacatacttatactaaaaaattattcgttgtgtatctgaaactcaaatttaattgagcaccctgcattttatttgacaattaatttatactaggtcagtcattatttttagaccgagttaatctaggtcctctgagaagcaggtgcaagtggatgtgcaagagagttattggagaaaatgcctgtgagggaataaaagagtgaatggaaaaagcaggaataaccctttgactgtgatgtaggctttactgctgtgaaggtcaatgggaagaaaggagaatagatagaaagagtctcaaactgtagttcaggtctaagaaatatttaggagggttctcaaaccaaagctgtccaacggaggattcccacaagccctatgaaggggactgcttcagtatctctgccgcctgcactcagtcattcgcctagcacaagctgtgggaagcatagcctcactgctaatgctgttgtgcattaggaatgagataataatgatatctccaaatgaaaatgtccaattcaatttcagggctattttctaaaggaacatcttctatttgcctcttatctatagtgaaaattatagttcttaaagccttggcgattagagagttagaacatctcataattactcatttacttttccaatattatacacacaacagaaaaaaaagtaactatacaaatattaccaccacccattataattattgaaaatatgttttcttgcatatgctatctcattctctccatttggttgtactaaatctacattggtagataatatagctgttatgtactctttcctacttaacactcaatttgtcttattctactatcactaaatgtgtaatccaccataattcttaggcttatgtctctccagttctggaatgttcgcagtggctcttagtgacatgaggtattggacaattgaaacatgtctggtctaaattggtatgttcgtaagcataaaatacatactggatattggaaatttactatacgatgtaaagtctcatagacaattttcatatatattagatatcaaaatgataaaacgtttagtgtgttgggataaataaaatataccattgatttaaattcttctgtttctttttactttcttcaggtggctactaaaaaatttaaaattacacacttttttttatttaatggcgatgttcctgttaattttgttttctaaaactgatttctagaagactcctcaaaaaactcccacgaggacaatattccttgggtgattgcatgttggtaacagtctttctatgaccgttataattgaaattcagttttactgaatataaaacctccggtccatattgtcttttcttgaatgtcttaaatatgttacttcatttttttctctctaagataaagtgttactgttggaaagtttaataataataatcttagttcctttttaactcaagtattcttttgccctacatgcccaagtaattctttttttcctctttcttaattttacttcgtgttgattgtactacgttaatattatcagttacactatgagatttttcagtaagtttaattgatttttttaaatttcaggattactttcttatactttttttttttttttgagacagagtcttgcactgtcacccgggagtgcaatggtgtgatctcggctcactgcaacctctgccgcctgggttcaagtgatcctcctgcctcagcctcctgagtagctgggattacaggcacctaccaccacacctggctaattttctgtatttttagtagagctggggtttcactatgttggctaggctggttttgaacttctgacctcgtgatccacccgcctcggcttcccaaagtactgggattacaggcgtgagccaccgcgcccagtcagtattgaattttttttttttttttttaaatccttgctttattctctcactcagaaactcctataacattcatggatctttttgccatctataatacatgtcacattttcttgaaacctctttctttattttttaatttctttttagtgttaaatatttttctccttctcaacttgatttcctttaaagtgttatttttgtacttatatcctcttattttccttctagattagtcttattcctactatgctgtttcttttctttctaattttttcttgagtttgatctctttttctacttctgattaatgtttttttcatgtgttgcatgatgattttcttaatgtcctttagcttattttaaaataatatgttacacttttgaaaacattttgagcatgacattttttggcaggcttattttgtcaatagcagaagttggtaaatttcctgtaaggttcaagacagtaaatattttacactgtgtaggccatatggcctgtcacaaatacttaacattgccattgtaccatgaagatagtcataagcaatatgtaaatgaatgagagtagctatgtaccaataaaactttatttctaaaaacagaaagtagactggatttggcctctgggctacaatttgccagtctctggtccataggaatttcattctatgtttccttgtagcaactttgttttgggggctaaactttacatacatggcatttgaccttgatagttttctgttgctcatttttgtataaatttagtttttttgaacttttagataggtaaaatttaagactgacttttcaacctaaaggagatccttcttctcttgttatgtaacagtaaaaaatagatatattggcttgttttcatagatttcttatatctgtttacctggaaacaggtttgtctggattttctctttcctgcatttttattatgtctattcagttcaattttgactccacttctagtagtttatcctcagtatggggtcctgttttggaaagatgcctggaagtttggtttcaagagttcacaggatctagactgcaccagccacctaagaccttgacatagacctgctaagaacaacgaaacagctgagattttatactgctttcgagctaatgagttaacccgccaggtttatggatgtcggcaaaagacatgagactgagggtcagagacaaagactttgattactcatagtataatgagtaggatgaacatgaacgtatttgtgtgagttcttcttctcctcaagtaccatgggaggggtggttaagccagatggatgcctacccacacagtagattgcagtttatagaagaggaaccctgagcttaaggaacccaaatcttttataatggggagtaagcatgcttgttttttgttccagaggaagacattatcttttttatactgaagagtaataatgcttgtcctttgctccagaggaagatactagtccttctttccaggttaattgctgcacaaatattctttaaaagatattatgaaacagggtattttcttctgataagaaatgcagaaatatgagggaccaatttcctgttgggaaaggggctccccacagggcccattttacttactgttggaatgcacaaaacctctcctagttccactcagtgttcttatgttggtccactgtagtttctagtgaatatgcattgactatttgggggttcctttcttaaatattttggaattatcacaactgtaatttgccctactgctttcttctgcattcgctcacatagacacaagggcacccacactgtgtggcttttggtgtttacggatttgcataggtatctagttatttagaagtggtgtaaatgttgtacatttggttctgatatctaactctctatctagcctaaacccatgctgtcatcacagcagcctatcttcccaaaataaccctttcaaaaaaagtatgccaagcctgattttaccttttttgaagtcctcattttgagcataaactttatttttccctaaaatacttatatttttccctaaaatacttatttctaagatcttcctaagttgcataaaaatacttgtctctcctacccctcccccatactaagtggtactaagttgttattattttaagtggaggggccagtgttttctttctttgctttctataacattctgtatcttattttcttgctatatttgtataccccatctatcagcaattccccttaccctctttccaaatatgttgtcaaaaactagcaaagcagataaacaagcttatttaatatgtgtgcagaggatgtaaagcaaaaataactatcttctgagattgagcataatcttagaaatttctattgactttatggtccttttggcagtatatatagtctagaggaatttaagctgtatttacaacaacaaatattttattcaatttcaatatttcctcagcattttgcccattatagctcttcctcctccaaatttagtatagtgtttatatattaggtaagaaataaattaggagtgatagtgcaaacataattctctccaaattctcctgtgagctctccacactggaagcttggtacttcataacacgtagtacctgctcctaagcagtagaaaattccatgcttatgtggcttttacttaatgttttagaactaagcaatatctgatgggttcttactcatatccaacatcagtagatcagatgctgatatgatgaatcttgataagatgaatcttgatattcagaggaatatcaagactatgtaattcctacatgtcaagtagagaaaagtaaaatattctgggacaacagaaagagaaaatatattttccctggatgatcctattcagtaaaataaaaaatacaagattataggagatgctaatagagcttaatattgagagggtgaataaagatttttttttcaaagagcatttcctctgaggctccccctacttaggcaaggagactgatgtagacccctacccaccaccccctgagcacacacacacagttaactccagtccccaacagaattcctctccactaagcattgatattagtagaaaagataagatgccccatatgacaattaggatgctgaacaagctattaggttggtgtaaaaaaattgcggttttgccattactttttttttttttttttgagacagaatctcactctgtcacccaggctggagtgcagtggcgccatcttggctcactgcaacctccgcctcccgggttcaagtgattctcctgcctcagcttccctagcagctgggattacagtcacgtaccaccacaccaagctaattttatttattttttttttttggtattcttagtggagacggggtttcgccatttgaccggcttggtctcgaactcctgacctcaaatgatccacttgccttgacctcccaaagtgctagggctattatatttaattgcaaaaaccacagttacatttgcaccaacctaatattagaaactaaaggcattcaattgtgcagtgagatagacactacaaagagtgaaagaagaaagtccctgtgaacttgcgatgggaaggttgtgaaaggtgttgagtcctaatagatcagttatattcgggaagatgaaaatgtgagtggatggcttctccatgtgaaaggtcaggggacccctgaagggaagaggactgcccatttgtcctgtgaggcttttgatgtcctattaactaagattaaacactcttataagtgttgctcagtaaatcaagttgctaactgaagggtgattttctagtcattgatatgtaagaactatcatatctgtaatagattcctcctcctcctctgatgcttacggtctaattgttaagtgtaacaaatgataaaatattacaaggcaaggtaagcttgaaattaattagtaatatcaagtataacttactgacagaggaatgaggaagttacacttttgactgcattctaaaattatacaaatatatagaaaaccaatggcagaagcaatatttaggcataaccagtgggatttatggtatttcatttcatgattcttatgaaggtgttaataagccaataagacttactacaccctaacatccctaacaacttcagaatgtattctcttggcgtttcccttccctttttctcctcctactctaccttgtctcttcctcttctttctctttcttctttgatttggataaagatctgtgactttagtaaatatttagatatgcaggatagaaactgagtgacttaaacatttccttactctcccaaaaagatacagatgtgtgacagattgacagacagatgaatataacaagggatatacactagcaagcaactcatcgtgtctaatagatgaaacagaattaaacaatgttcagtattgaaagatgtgttttaatgtgtcttatttcaatgtactttgcctcccctgatatcccgaaactattatttgtataatcacctgactctgcatggtgaaaggaacccaaggacttggcctcaagtttcctttggcaatagtggaagaaaaatccccagtggtagaaagtcaattggtagagacaatgccagggactctttaatgtcagcggatgctctagggctattgcaccagaatcttcgactatctcttgttttctaggggaaaattcatgggagaatttgaatctagtactaaatctttaaaaacaaattgaacattgtggaagtgttaaaaaagatgaaaatctttccttccaaaaattagtcaagatcttacagtagaattttctctttcgatttgtaaaagattttctagaatgggaaatgtgttttgtgctattatgggaattttataaggaaagaaattgagtaaccactatgaagtctaaatctaagagaaggctcagtaatatcgtacttttcaaggaataaaggaagattattttgaatcattagggaatcttgtcttggttatggaaacgagaaataccagattcaaagaaatttattcatcacaggcagacattatctcaaaaggacaaatgcgatgccaatgtttctaaatactcctccatacatagcaacctctgtcatttgtagacaaatctgattgagaaaactttattttatttctaaagagttgtgaaaatcaggaaaaaaaataccattaatatcagctcaaagagatgatggaaggttttcttttttcttttttactgtgccgacataaccaattcattaaatgacaactcttaaaaaataaagagcaaaataaagaaacacacatcccttgttgggcatctagtgggtaaacatgacaacagcaggtaaatttctcacgttctcaagttgttttggtgttacaattcagctacatgtatacagagaaaagcatacacggtaaaataatctgcattgttttactgtcttaattcctgtatatatgacacagaagggcggtggggtgaaaggaagatgtgaggttttaaatatagcaaaaaaaaaaaaaaaaagagagatttgacaacactggacctcagtaggcatgggcaatttgttcaatatcttcaggtctccagagagcaagaatgactctcaggatattgcaactctgtctgcttccaccagagatcataattgggctatgaatttttataacaggaaagtcttcctgtcaaagacagagactgacaaaaactttagttaactgatactgaaagaaactcaaaacagaatgaatagtatacatgagtatcacttatatatatagtgcctttacttctttcttcttttttactttaaaagtaaattcctgttatagtttactggttagagcttctaaaatgtagcttgtttatgaggattgctcagcatactggttttctgtccagggacatgatgtgcattttggggaattcaaaacccgattgaggtgagtagaggtcattcataaatcgaaaccaaatgatagcagaagatatgaactaaagctatttctttatctgcaaagagctaattgggcatatttcaggccaagtctctgaagacacagctcgtgaactctgtcttcttgatgctgtgctcattatagacactcaacagaggactggctaatgctagggaaatccccatcaaggtggtctttacatgacactgcagatttacctcaggaaggggagcaaagagaaggaaaatgcagtgagggtttctagcaactagctgcttgtggagtactgtttgccttgtctaatttatctgaaactgaagagtttgtctctaaagggtatcctacttcagaaaatctcaagggacatttgtctttctgacatatcagctgttagctagaccttatttcttacttggttgtttttagagtaaattttggttctttggtcctttgtctgctatttgaggtggaggattaaatactgcatagatgacctatgtatgtatagaacaacctaattttgccacagataccaaaacactataacgataatcttcaattaatccaattattatctaaatttcataacccgtcctcaattatctaccttaatatttctaggtaaagagagatgtactgcattgacttcctgtttttaaagggtaaaacagcaagagaaagaaagacattgtagatattcacaatgttgtatgtgaggaagtttttgaatggcttcagaaacccaaatgaatatattgagaaagcagcattgtgagttctgtctacatgtgaacccaaaactaggatttgaggtaatccattttcagaaagaagtgatggagtttgaattctaggaaatcttcctgaataaaatggccatgtgttgtaaagtttagatatttataacccaaaatagaaggaattttgctaggtgatctctccagttccttttcagttatgagagtctgatttcttcccatgaaaagtgtagaaaaacttcctttactgttatatgaatgttataaaatgtatgcttgtccatgaattagctgatcaaagataatacatgaaaaagtattcaaaatactctgtgaatcttttttttaaaaaactctctttaaatagatttttgtattcagaagttatgctttgtaaatacattttaaatttcagatttaaacattatcaagacaaaattgtgactatgtgcatgtaaaactagagagcactggaaaatatggtggatggtaagggccttttgcaaggtaattaacttatctattgagttttttttttttaatttctaagtacttaattgactctcccactaaaatttaaacatatacaaataatttttcattcagaagataggcatttgatttataacatcaacatatcatcacaaaaacttagagaatgagaatatcttaatgggcacctggtctaaacattttaattttaccaggtaaaaaggtggaagtggcatggcatggtggctcatgtctgtaatcccagcactctgggaggccggggtgggcggataactaggtcaggagatcgagacaatgccggctaacacggtgaaaccccgtctccactaaaaatgcaaaaaattagcttggtgtggtggcgcgcgcctgtagtcccagctacttgggaggctgaggcaggagaatgtttctttaaaaataacatcattagaaaccatacaaaacagaactgcaaatactcccttctaaggtgtaaggtattccaacatttcttgtttggacgttagaattttttcttcagtaagaaattaagttgaaaatgaagtagaacatcttacactgtaattcaagtgcaatacattaaaaaaataaaaacagtgtttaaattgggaaaatccgtttacatgtgattaagttttaatcagtgcccttaacccagatctcaacagctaaaaatgttcttagcttgacaaaataacaacccatccccaaggacaaatacttaaatcaaagaagcattttataaataaaaaaattcacgcacacatacacacacagacccccacaatacatgaaacatataataatgtttgtctttatttgtaatgaagtggattttatactgaattcagaacacagatgcaaattcaacagttgaactcaatcaaataagtaatcttatataaaaggatatctccctccagcatgtacttatcctgtgtgacagatatctctgtaataaagtaaattccttcaactcaagcagattgtccgaaatggaaacacaatgaaaggatgaatatactcaaataatcaacagaagagcaaaatataaaaatgcgaacattttctgaataatgcagatgccctccctccaaaagaattacatgtgagggaatatctatattgtcataattactggataagctgcccaatagctattacactaatgtttcattaaaaatatatatttgctttatgcttttgcaacttgcaaagttattcctagcaaaaagttatttctcctgaaacagaataaataggtctttcacaatatgcactggaatacatatttttgaaaaacaagatctccactcacctctaattctatctttctgctggtgattactgatatatttattttaaaatacatactttataggaagtatcgttacaattaatatttaggacaacattataattcgtgttttagaaactactaaggcaagaggacagctcctaccattctacaaaagtctttcagttaagaagtgactaattaatggactgagtggctcagagcagggagccagtccttagccaataaagcccaactcactgccaccccactgccccatattctctgtcctctctgctggaactgtcttgtgctgaatacatgaacacctaaatattcaactcactcctgccatttctccggtaagcaatcttccacaacctgtgcctgagacttggaggctgtttgtggtccacaggctttaggcgccctagggaaagccacgtgcactagtgcatctggatgaactgtggactttgtctatccgcggtaattcaacttcctaagagctacattgactcattgatttgtatccaggctccgggctcccaattcccacacaacgtaagctccctgcagccaggggatttggtaggtttgccgtgttgtttagtttctctcccctgcgaccctctctctgagcctcacagtgtgtttggcacgtggtaggtgctcggtaaacctactttgaatgggagagggttgtgttgaagaaaggaaaggctgggaggacttaagatttgaaggttttcctacacgtgtccaggaagaaagaaaaagaaaaaagaaatgagtatcagagtcttatcatcattacagttcttatggtttttaaccgacctttaggagttccaccgacgtgacccaagcagctggtaggagaatctgggctggattcggaaggcgcagctacaggacgcccgctgccccggatcggaaggcgcagcacctcaggccacaatctcagacacgccctcgggtcccgacaggtgttgcccgcctcccacggggctccgggaccccggtccccgggctgccccctgccttctggggcgctggagcgcgcgcagtggcggagctggagccacccagtgcttcgcacgggcgcgctccgcttctccgggttttagcggaagcctgcggggggcggggtaaccgcggaagccggcggccgtgggcgcgcgggttgggggctctcgcgccgctccgggctctccccccccccggctgcggttgccgaagagaggccggagcgcggcgcccggctgctccacctggcgcgctgagcaccgcgcggggagcccccgggggcgggcggtggggggcgcggactgcgggaagaaggcacgaggcgtcgccgcagctcggtcaggggccggggccccgccgctcgccgctgcactaacttgccgcttggtctcgcctcgccgccgcggctcgctgcgctttgggtggcggggggcggggagagcggggagtcagagggtctgcggtggccgagggagggaccctacgacggggagcccgcccggtgccgctcttcttcccctccccgcccctccgctccccccaccccgtcccttccgccgattccgggagcgacgggcgcccgtgacctgcgaacgctgccaagtgacggtccccgagtctgaagcgcccgcgaggaagcgagcgccagcgcgggccgccggcgatgacggccgcgaagcaggagccgcagcccaccccgggggccagggcgagccaggcgcagccggcggaccaggtgagagtcggcagccgcggccaggccctcccgggaggggtggctccagtgcgcgctccgcccgcctcccgcttcccaggctgggctcccgcgcctccctcttctcaccctcccccgccccgccccagttccaggctctcctgcttctccacggactctgcgggaagttagagcctctgcgtgcgctccggggcccggcgagaggatgcgcaaggtggagagccgcggggaagggggcagagaggtaaaggctgaaggtgccccggggaaccccggcgggcggcccaccgagggagggagaggcggccgggaccaaggaatggggcctcttggttccccattaacgcacgctgaagaaatctgctgcgctcctgacggccgctcaccgggttcgagccccgtcctcctatagccggggcgctcgctggccaaagcgacccgagcaggcgaatgacctttaggcggacggggttttccctctgctttcttgtttcttttgaggagacgggtgtgtgtttgtgaggtggggatgggggaagagtgtcccagacatccgtagtctgctgagcggaacggagcttggggagcggcgaggcattaacgattaagtggagccgggaaggcgctggctttggtgatgtgttgggtttggatgtgtcgcgtctgcacagatgaggtgccctgcgtgggctgagggttattcctgtctctttcccgtccgtctacacccgccaacccctttttgttttggtctttagaaatctgtagcataaccgtaccgtcgtggatccccatctcgtctctgtccctgatctggggtgattgggacttcggtgtcgctctttttccaaagttggagggtcgggagcgccgagacaccctggcgaggaggaggaggaggaggagggaggctgcgctgagccgggtgcaggtgcgctcacgtttgcatcaattaggaactccgggcagagagagctgcacttaggtcagggattaactgtggacccgcgggacccaagcgctggggtaggaggactggggatctttgttcggagtgcgctgcgaaggctgctggaggcggacaccctcccagcttattgctagcgtgggatagagggagcgcacgcggctaggctccagcagcgactcggcttttcgcgtattctaagcactgaagagcctcttaaggggagctgtccaaatcgcccaggagtggtggcgagacacaggaggccatgccagcgatgctgttattaatattgcagacttggtcatctctcctggcttgcggtttcttttctcctcttccctccccttctcttttctctcacatgtgtttcacacaggtggtggggattactcaatgacttacagctcccttctcgtttattagtgggagggggttgaatgttggcagttcttacaaagcatttgttttcttaaacgatcctgtttgatccatactctgagataagtatgaaaatattaaaacatcatacgttccttccttttataccccttcctcctaatccccagcacacatcagaatgtaaacattggttagcagatatagaaaaataatttcagaacgggaacatggattgaacatcctctttcaggctgacagcccttaaatttcattaacaagccgccgagcctctctactgctctgggaatgatgctaccagtaagaaagattagccaggtgagagtccccacatgaaatctttgctcactaacctgtgacaccagctggttacttgaggcgctgcaaacagttcagtgatggtggaagtgggatgcagaagcagagcagagcagagcacacaggagctgaaaatgtatgtgtagatagtggacacgctgtctatacacaacaaatccccttgtcaggattaatctggtacttaaaattcatatgaagagataggtgcaagctcgaatccatttttcttgttagtgtgcattttttaatagccacttcaaatattcagggagtggctactttgcagaactcttgttttaatagagtattttaagtgcctttctgagtattgacatgatttgaaaatgtcagttttatgaatcttatgcatgtgttctaatagattgattttacaaagaaagtcaactgaaatatacacatggcacctcgcagtgagggtgtttcaagcactcccaggaaatactcatatctagcatatttttgttcaaagcttgacatatgaaacgatggaaaaagaatgtgaatgatttttgtgacagcttaaactactttccgtaagactactaagcttttattagccatattagtcattatggtttaattctgcaattgccacacaactctcgtgcaatactagatataatatagcttcataaagatgtgattagttgtgtgttttctataatatttcataaaaaagattcataaatttaaattaaaatgtacctttatgaaattttacctagtggttaaatagggcacatgttccaacaaatcaatcactatgcattgattttgaatgatttaagctattgcatgtttccaagaatgtcttctagtttctatggtgaagatttttatgaaacctcaaagatgccttgtcctgaggccatcaaacacctatttccacttatagcacagtggaagaccataatccttcctgtaactgaaaatggttatgaaccatataatttggttacagttacagtcctgtagagggctcaaccttcctcttttatttgatctgttagtgtcctctggcacagggtgccatgacaagaggacatgccctccctccctagagaatggtgacaacaagaataggagggaccgtgtagggaccgtgtattttatgaatattctgaatcattggaaatatttttatcatcttagtaatctttcttttaaagattctttgattacaaaatatttatgacagttatttttgttgctttcacaacactccacatttacaaaatatctaaaaacaaatgccttgacatgactagacacaatcatttcttaacatgatcaatatctcaattaacattgaaagagctaagaactctagtggctaattgtaatttattattatttttaaaaatcacttcctgaatgcttgccacaggcagagtactattcttagggttcataaagtaacatttcttgaatgtatttttctatttgattctcaaagcagttttttgaggtgagtcctgtttttattcctattttagagatgagaatacagaggattaaggaagttattgtggaagtgagacttagccaggaactcatggaggtctgaagcctcaacttttaacttctatacaatcatgatacaacatatttctattgtaagaatgaaaataattgcaaattatatgtgtatgtgtgcacatgtgcacaaatttaccttgaatataaaacaaatgaataatttgtttaaagcttcaactatacaagtaaatcacagctctgctaattttagttaatatcacgctactgatctaaataatataaaagaacaagatagatcctcataaatttataggagctttttttgatctttgtatcatttgtctctgatgacgagactctcaacgtttgttaaatgagtatatatatatttttaatggtcaatcagacaaggtttagagtttgttcacatttccaccaggtggcacccttctgctgactccagtgggtaaaaatattgcctaaaaagcgtggctgttctctcagctccaaaagcaaaacaaaaataaccacacaaaaacaaaaacaacaaaaacaaaaccatcccactttttagagtatgactaaaaagcatatttttaaaagcaactatttgactacaaagacagcacttgttatgcattttctttaaaaaaatgcattttggtaaaaaaccaatctcttacaattgaacgtgaagctgtcacttgatgaaataattcatgaccagaattgagatcaaatgtgtaatgtgtaaaatgccttctctgaaatatcgatgtgctttagacatttaggtaatatcaacttaaaatgttttaatacagaaattggtattcagtatttttattttacctttggtctagcaaaccagattaaatattcaaacatatgcttaatgaaaaattgcaaaagagttattcttccatgtgccctttgctaatatatacacatcataatttgatcaataaactattgtttttaaaacacaaccatgaaaagagctttcataaatcatattgaaaaattttaattaataaaaaacatattacttcgaattattcaacatataaaatgtcatatttaattgggagtagagttctatataatttggttataaaagataatatacattaaataaagatgttatatggaagtctatgatttgagagaaaatatgcatttcctactctccctgaatttcttatttttatatgtaaatattatatattatataaatttataatataaatatatatataaatttataatataaatatatattatataaatttataatataaatattatatataaggcattttgtttattaagaacatacaacaaatatctcttgcttagaatcttctaatatatctatatatctgtttgattatttcaggatctgagcaaatggtacattttaaaaagattaaattatataaaacaacttaaagaaaattgtattattaaatatcaatgctgcattatcttatgaagcacattacattggaaacaaaacaaccaaatttctcccagtctcagtaaaaataaagcaaattcaaaattttggtttcttgaattatttatgattacagaatgtcttaagctttactacttataggcacattttaaatttacttacagtgtgacatgtagcagacacaatgccagaatgctgtgactaagattgtgagattttgtgctatcaacaacaaatatttattcatcactgtctatgggttatgcactggaagtcacagagtcaagttcatatcccaggtccgccaaagaccagtgtgttttcttgggcaggataactgaatttccccatttcacctgtgaatggaggtgactgcagttccctttagatgtttgttctaacggttaaatgaaataatatgtaggagtttttgaataaggtctgactcataccaagtcttcttattaaatgtgtagtctgggaataagagcctagacaaaatagaaaaaaaaaaaaaaatctgggcctggtgcagtggctcccacttgtaatcccaacactttgggaggctgagatagatggattgagcctaggagttctagaccagcgtgggcaacgtaatgtgactttgtctctaaaacaaacaaacaaacaaacaaaaaacaaaaaagaaaataaaaagaaaagaaagaaagaaagaattatcagggtttagtgacatactcctgtggtcccagctactcaggaggctgcggtgggaggattgcttgaacctgggaggtcaagaccacagtgagctgagattgtgccactgcactctagcttgggcaacagaacgagaccgtctcaaaaaaaaaaaaaaaaaaaagcctcagattattaagccgtgtatagctgatccattattttaagtttacagacaaccatattttgcagtgcacatattagtatgattacacatgagtttttgggtgcatgcaaatattatattaatggatttggacatcaatcctattttggcaggcatccagatttcaaaatattctgttacatcctgactttcattcaatcaaaattgaatagtaaaattctttactgttctactctgtaagaagtcaggctaaaagtaaactttggctaattctcaccaagagttgaattagctgctgaatatgttgcatattgttttcaatgcaatgtacttcccaaggtaatcagcatgagaaagaggatatttaaaggaaagacagatgggatttatagaaatatgtcagggggtgagatttcagtcaatgtagcaggagagtgtgcttggcagtggagccaccaagaacccagggtgcatgtccctactgttatggggaggggcatggaattggattaaacataagtcaaaagactttttcacaaattttttctacacctttttctgtgtaacctttaaacacacatgtatgctccacttattaaaatcatctccatatattttcatacttgctaagtgacttgtgtgtcctaaccaagttcatgtatgactaacattagaatgggggccatatactaagacatacatcaaccaaaaaaaggttggaggtttttccatctgaagacttgtgcaaggtccaaaaagaagccagataaatgataaagggactgtaaacttcttcataaacttatatccttatggatagttagaattgttcttgctctagtgaatgctgtcctgccttgagaagttgtggagtttagtattgattattcccagcatactcttgttttaaagtttttattgacctgatccacaagttttctggcaataaccaatctctgtttatttgtccctatctaatagcacctgttctctaaggcttttaaaattagcacttaccttctttctacacggtagacattcttatcattgactacatattaactcaaggaatggttgtcgttttcagtatagtagagaaggctgggaagtaggttcggtggggagactggggcactgaaaagaaagctcttctattgtagatttatgtttgttaagctttcctaaattcttagaatctcaggcatatccatttgtaatggtaaatgtgtcatccactgccaggctaaatacagaaaactcacttttatccaaaactgataaaataaatattttgaattgttctgttctgtaattgatgtgaacagtattcttttaatgtcttccacaaaataaaaaaaatttttttctaagtttttcatgccatagtttatttaaaagttattaaaatattctataacatttttggaattgccaaatgattttcaaatttaattacattttggggagaggcaacgtgatgtaagactgagaacaaggtcaaacagatttcagattgattccttcctctgccatttactaggcaatttataatcccactaaaatcattctttcatcttgaaaagggagaggatgatgagaatgttgcaataattagagaatctatgtgaatgagtttttattgcatctggctcaagcttgaaacctagtaagtattttcattcttaatgctatcgtgcttctagatcatctcagaaggatattttcttcttttacaaaagtaaatttgcacttatgtgaatgaaaatgctgaatatgtgtgtgtacaccattatcaaatatatacacactatacacacacatatatatatatttatgatctaaatgctatggatcttttataggtagattattatagggcgttagatgaaaatgaattcgtgacaacttgactgatttctactatttttagatgaagagtctattttcacaaaagacttagagtcttgtttgatatgttcatggtttaatattctctttccagaagtttggtgcccaggaatgatttacttagaaattctttgcatacgggaacaggtgatattatttagttgaaatttaagaaaagttagttgagtgcataatcaaaaccgactttacatttgggaatgttctccagccaagctatgtattatctaactttaatattattgtaattcgtcatgcttactggttttctcaggtcaagacaaaataactatgtatcagattataaaagatagcaaatgaagaaaagggaggataaaagctatttttattattcttatccccactctctttttgatatgtaaatgaagattcagtttcttattccatctgagaaagtctgctctgaaaacagaaatgtgacaaatctgtattacgtaatcaagaacttgagtggcaggctgccctgtgatttattttcaaataatggaccagagagaccacttgaagttgcattaataatgcttgtacagggagaaataggcctttcttgttattggaacatgggtttacttttggcaagagttgagtaagtgaaaactctgatattcatacttacattaatcacatctcacctccaggaatggttttaatgtaagttaatcaatgcaaaacatggctcttttttttcacttcacatgttttaaaacaagtactagaagtctttcataaagcaatcctttaaatcaatgtgtcacaaatttgcattgataattcttctctcttagacacagaatagaagatgaggaactgagacaatgtttgaatagaggtaaaaatatatctttttgagaggaaaaaaaactgaaatccatgaaggattcctcaaatttagaataggtcatttgtctggcaaaattagtctataatttaaatttcctaggatctatgaaattatgaatagattttctatctacctcactagcttttagggacttcaagggaaaagacgatacgtttcacctgtatgtacttttttagagtactataaaacataagtggtccaataaataaagtgaacatattttgaagccaaacccaacatcttcatcagggttatttctttttttctgatcttaggaattgtgtgtaccctacttcttgacacccatagtgagagtgataggcatgtgtgaattgaaccagaagttgaaatgaaagaaactcccctccctcacatttatgaaggttgcttataattgctccaaaatgagatttgctcaactttaggccactgtggcatgatgagtggctcattattacacatttctatttgctcagcgtcagtatctctgcactctaggatggtacttctcgttccttcatctctctttgcatgaatgccatctccaaacccaaatccagttccctccgcctctctacatttctgagagccatcgtctgtctaagagttgattgactttctgagaaagaatactttgatattggctgggcacagtggctcgtgcctgtaatctcagcactttggaaggccgaggcaggtggatcacctgaggtcaggagtttgagaccaggctggccaacatggtgaaaccttgtctctactaaaaatacaaaaattagccaggtgtggtgccacatgcctataatcctagcgactcaggaggctgaggctggagaattgcttgaacccaggaggcagaggttgctgggagccaagattgtgccacttaactccagtctgggtggcagagcgagactccatcaaaaaaaaaaaaaaaagaaaagaaaagaaaagaaaagaaaaagaatagttggatattggtagcagcattgcctttctaaattatttccttcaaatagccatgacatgaatgataaatgatgataacattcagagaaactgttgtttcctaaatgtcacacctttgtattcaaatcaggaaacagacaatggagaggtgaagtgacttgtctaaggtcacactgttgtttagaattagaagcagtacttgattctgggtctctttccatctagccattcccagattcagctgctggtacaaagccttcggtggtgtcatggtagcacatctgccttccttgccgcttaagtataaccttaaaaaaaaaaaacaaaaaaaaaacaagttttaaaatgctttgtgtccataggcaaggctcatttgacatttcttgatttctcctttgtgatgtgctagttctaggtcagtggtccttagacttttggcacctggccaccagacatcacagaagtgcatatgcatcttctgtactttgccatggcaagaggttacacgcaaagccataatgccattctgaacgtaaactgtgaaattcactactccagtgaaatggcagtgccaccactacacaaacagagttgactttctcaagcttcccctcttacactcagcatgaataagcaactgctgatatctacacacagcatctgaaattgcaactcccagcaatgtagtagcaattgggtgaatccctcctaaaggagagatgctcttaacaactggggaatgcatgcaggtaaattttagagctttcttgggacattaatggaaacaacagacttctgatacactgggattcttggtaagaaaggcttctcccccgggcgtggtggtgggtgcctgtagtcccagctactccggaggctgaggcaggagaatggcttgaacccgagaggcggagcttgcagtgagcccagatcgcgccactgcactctagcctgggcgacagagtgagaatccgtctcaaaaaaaaaaaaaaagctatttccagaagctgattatttgtatttccagacagagttttcagagcaccaagttccaatacagaccagagaaatgattatatgctaaataaataagtccatgaggataatttttcagacacatgtaattatttttagtggatagacccagggatttctactcatttaacctgacgttaaaccctagaaccttgacatactagtttgagcaacttacccagcctctctgtatctgatgcttcatctgaaaatgaattgatgtttattttgcagaactgttgtgaggatcagcaatgaaataggtttactatccaagaggtgctgaaaaatggtggtgcttattatttggttattaatatgtgttgggttgttataccggacatagacagagcgatggaaaatcaaactatgttggatgttgaagttcccagaagttggaaacacagctttaaagcaccttttgtcattgtttgacattggaagcttaagggcatctttaatattgagctcctgttttggttggtatgcagattatatagagtcctcctgactccaaagcaaacatggattgggagttggttaagaagctgcatggcatccatttttatatttcttatcacgcagagaagttgacaaagtttatattttgaaaatggaaaactgaatatgcatttacttttctgaatttgttttttttcccttccccatccccatggttaaattccgtctcatgcttataatgtattctgcatttggactgcagcttcgttccttctcagagctacagttcttgagctgtaacagcgaatccaaaaaaactaatatggaatcacagatggtgcaaatatttgaaaatagataaatacaatctaggattagctgcttggactcagaaatgtcagcttcacattgcttattggtcacacaaggcaattttagttaaggaaaacacaggacaaagccatcatgatataaaattgctggtttgaagatgtgcagcataacaagcccataattgttatgtaaacctcaaaatgagtcattctgtaacaagaaaaaggtattttagagagatcacaaagcaccaacaggttatatagggctaaaaaattaagcagataccataactcgttcctgttgtacagtaccatctgctgacttccatttacagccaatttttaaggagaaaatatctgttctaatgggtatgctttaggtaggcacatattaaatgacctgagcatgagatgcaacagtcaaattgccagcgtaaaatctgcagatggtaattattagtaacatgcactgtgggctcatagttctgactctgagagtcttaaataatagaatcccattttctctccattatccccctttaagatgtacatatattctgaaggaatcttacaaccgactatgtgattaagttatctggtttactgataaggcagttgagaacgataaaggctgatttgctcaaaatcatacaactgatcagtttggtacagtagaaagaagagttcctcccacctaggttaagagttggtagaaggagcctcactcaattatcagaatcatagaaataactttggattgtctgtgatgatgtcgataaagaaaaaattgatgagaatgtaagtggaaaggttccagctggtttaggattttatttttatttttggtagcaggtttaataagaagatgtattgtatagattctatctgaaagcaataaggttaactatcatggtttgtgtaaagtctaggttttctgcagtatctcattttcctgatgaagtagaagagagtaggaagacccgttccagatcagacatgaagatctataagacagtattgatcgctttcaatgtacatgtttccaaatgagaaaatgtggttctcgtataagtatgtagtgaatatttgtcaataatttaacttattaaaggagccatcaagatggtaaagttggttcaaacagtatttgaggaagagagatttatatagtctgaaaaggaatggcttacaaagtttccaaaattaaatacaaaactggttaatattcaggccataacttttgtgtttgtctttgatagcagacagaaatttttgggtacttatatattttctataattaacatctaactttatagactgtgggcctatgtaatagcaaatagtaagagaaaatagggtacattcccctaaaattctataatcatatgtcggctgattagatagtgccccagtttgacattgaaaagatgaatgtatagttatacttgtttttatttacagttctcgaattgttttcttaacattcccaagctcagaaaaattgtgcaatctgggcctacacttgatgtcacagccaacttcttaagtcatgttattaaagttttctgtaaaccctgtggagcttccagtgtcagatttgattcaccagcagtgaggtcctggaatgcagccagtcagccaacattgcttgtcgggtttgtcccaagaaattgatgcaggtgtctatgaaggctagaggagaacaatttggtagtctcaaatagcttttctttggagaagatgagataggataattgcacacaaggaagtgagaaaccattcttgaaggatttagcaaaatgagattcggatcaagctgcgtggtggtagttgttcctggagatggctacttttagaaactgcccttagggagaagagagattaactaccaacatggtgtgatttaaggcatatcataaattttcattcccttgtgactcgcatctgtgactgtcagtgctctgaaaaatagctcttctcattcatctgtgtagctctggattccaccatgacttcctttgttcctttaacttctggctgggcaggggatattaacaatttatgtctaacttgtatcatttcctgctccgtgattgcttggtatgctctgtcttgagaacccatatttgggggccagagaagatgaaggtcttatgaatttaagaggggtgggggaacaggaagaaataaacatatgaatgggattgggaacctcaagagagaatcaccacttgcacatggggcaagctacttcccttcccttgccctttcctaccagtgttaaaaacaaaaaaataagtttacatgagtacttctgtgcagtgtaaaaaggggttcaatgaataatttggagtttaaaaaacttattgaataattgaaccttagtttcctaaaatatcttttactttctcacagaaaagaccagcgctattcaatagtacatactggaaagatgaaaatgttctgtattggtgttttccaatatgataaccaccagctacacatggctatcatgtttaaacacttgaattgtgacagtgacactgaagaattgtatttttaattgtacttaattttaattaatttaagcttaagtagctgtatgtggctagggctactatatattagagaatcagttttagaacactatccaaactttaatgtgggtatgaatcacttggggatattgctgaaaagcagattctagtccagtgaatgtgagctggggtccaagattctgcatttatagcaggtgcccagatgatgcctagtctgtggaccacactctgagaagtaaggctttatttctcaaaagcaaggattctctaatcctaatttatgtctttagccaggctgacacttgtcctagaggatgagtcagatgagcctgtagcaaaattacaaaatatgactttcaaattataaaaggaaagaatttcagtgacaaaattattagtatttttattattgacagtagctaaaattttgtgtctatactatttatatatgttgtatatttatattttatatattttataaaaaatttaaatatatttatatataaatatatatttgttatatataaacattttatatttataatatttatatatttatattatgtaatgtaatcaattgcttaaattttatttaatcctcaccataaccttatgtaatagattccacttttattccagttttgcaaatgaggatctgaggtttattaaagttaagagactcccaagactccacaggtagtaaatgcagaagttgtcttttgatcacatacagtcatacatattataataaccatcaacttctttcctgttattaagtggaggccaatgatttcccacttgcggctgatcaataaatcatatttgattcttttctacaaaggataatagtaagagccatactagtagttgtagtagtaatgctcactagaactctgtgtacaagttagaactgtcatcctcacttcaaagatgaggaaattgaggttcagagagggaacctctttggttacataatttgattacgaccacataacttgtaggtaggtggcagaactgggttttgaacctggattgtctgcctctggagtccatgcccttgtctgttccagtagacagtttctcatgtgtttggtgagcacctgctcccttaggcaatgcactgtgagcatggctactgccttctgtatattcaattgaaaatggagtttactttgaaaattttaatcatgtataattttatgtctatcaaaaatattttaagacaaaaagtcactctttattgtccaaaatgtataatttagtttgtagcatctttgaagccagtttttaaattcgtttgtcatccatgaagctgactttttaattgtgcatatttagttttagatcttacctccacttttttattagtgaagaactggtgagcactgtaagacatgtacatgtacgtgtgtgtatatgtgtatatattaatgtaaactttacaatttagaaaaacttaaaattgtcttccttgtctcccgtaatgaacttgaacgacaaattggcttcatcattttatgaaagagaaggtgaatgctttgctcccggtttttcagtaacctaagcatctgatttaagccttatttttcagaggtctttgtcattttgtttagttcggcagtcggtgctaacggagtctatttttttcacttccaattttaaataaaacacacaatcttctttaatttctgaataacatattcatgtagttcaaacatcaaatattacacaaatatatacagtggaacgtctccttcccagagttgttccccagctgtgcagctcctcattctgtcattcttttgataggtaatcactaatattattttcatttctttcttccagagaaatgtttgtagtttcaagctagtctagacacattctttacctctccttttataaaaatgttagcagacatgtttattttgaagtgtataacattgcttttgttttgttttgtttttgtttttgtttgtttgtttgtttgagacagagtcttgctctgtggcccaggctggagtacagtggcgcgatctctgctcgctgcaagctccgcctgccaggttcatgccattctcctgcctcagcctcctgagtacctgggactacaggtgcccgccaccacgcccggctaactttttgtatttttagtagagacggggattcactgtgttagccaggatgatctcgatctcctgacctcgtgatccacctgcctcggcctcccaaagtgacattgcttttttttgataaaaaccttgatattatcaaaatagaccctctaaaagttggcttctttaaaaaatgttcctccttttttcatgatgaattagatattatgtgcctcataatctgataagtgatagccagtcttggtgcaggtgtgtttactgtgcccttgcctacaaacagaagggaagagccatgctctccacacattgcctgacaaagagtaggtgctcattaaacacctgagacactgtctaccggagtagacaagggcatggactctaggggcagacaatccaggttcaaagcccggttctgccacctagaagttatgtggccctagtcaaattactttccttctctgaaccacagtttcctcatctttaaaatgagaacaacaaactaacttgcacacagtgttctaatgagcattattactaccacgactactatgaataccactactgtcatctgtggaggagagtggctactttactggtcaaccacaatcagcaaatcattggcctctatttaataaagaaaataaattgatggttattatgatatgtatgattgcatgtaacctaaagataactactgcatttattagctgttctgttttgggtatcccttaacctctctgaacctcagctcccaattagcaaaactggaataaaagtatttgatatgttggcatccacttcaatgctatatctgtgcatgtgtgtatgaatatgtatgtatatatacatttatttatatacatgctttccaacttaggatgaggttaggtcctgacataaccattgtaaatcaaaaatatcatcgggtcaaaaatgcatcataaattgaaactatcataagttcctctacctattatgggattgtggtttctactggatgtgtatggctttcacaccatggtgaagccaaaccatcataatcgagggaccatctagatagcattggtctacatatgttaatggggatcttaacaaattaaaagtagaaaagcttcctccttatccccagcattagactcaagtatgtatcccagcttttgcagattttaataagttgaaaataatgaatgagcctttcctagtagatgggtaaaagaaaagggctattattgaaatattctgaaacacaattctataccttataagatattcatgttaaggaaacaataaaataatatttagaaattttaatgtagaattgaacaaattccctctattttcttttataataagaaagattatattcctggatgtttgaatgacactgtgaagtctaaaggctagtaatggacataatcccgcattattaaaatgttgtttctgtattattattaaaaaatatagagactctcaatacatgataatgaatacgtggtgtgcttacgttttcttatataccgtgggataagcataatttgagaaatgagaggcatttctttaaacaatagactgtgctttattcacctgtcttagtctaaaaaggctatatgttgctgtcagtcacagcaaaccaccctctcagtgaataaggagataatagtatttgaggtaaggatagaagaccttagactttgcagaattcttttatgtttgcaaagaaaaattacctcgataaattataagcttatggatttttgtgtccttaactcctcatatattgaggaagctaagaattattctaaacttggcaaatttatttggtcaaaatattcctctctattccatcaagtagtaatggaatttaacaaacacaccaggaagaaaaatagcagcattgaaatgttttattgatccgtaaggatgaccagctctaccaagactcgaaaccgtttcacagaaggaatttttagttaaactattcttaacaataggaaaaacaagttatttcttttaagattctgtagagattatagagctttttaaaatcaaataacctcttttctctgaaaaattttaaagaaaaatcaattttttacaatacacctgctgaattattgcagggcatatttggtagctgctaatcttttaacacaaagaagaaacttgtagttgttaatgcttctaggaagtcaagctgctgaatggaaagtggtttttagagttcagattaggctttaatctttgatgtcctgctgggaatattaggagatgtatgggcatggttgaggagaggtacactgatagaaatcaactacgactttgataatttttttcaagaatcttattaagtaacccagacagaaaaggtacatgaaatgttaccaggcagattcctgatttcatattataaatactgaataggtatgacttgaaataaattttaatcagtcactacttacatattcgtacctaaaatttgggtaatggtaccatttgattctatcataaggaatcaagcctcttgtgtgttataatccaggatctttaggtcaaacctcttccttttgtgaattaacctgaaaatcctgtcagatcttctaattacggtgatatagggaagtttaataggaagtcaggattcccttgacctctgagatttcagtgtttggcggagtaccaagctctctgtttcaccagctactgcagagtcttatgacatacccaatggttgaattataagttatgcccctgaatacatctaaccatgacatcctctcactagaaatgtacatatgtatgtagatacccagactgatgctccaaggaaatgtttctagattgaaagggtgggagtgggcatgaaaaaatgtcctttctgcttatttatctcaatgtccatggaggtaactatttataatggaaggactgagggtaaccccaagaactcttgattataatgatgctctctccctccctccatgcctcccttcctcctgcctccctccctttcttaagcaaaaaagcaacaggaaataaagaagtgaataaaagttgtctcttttcctaaaaatatacgtcacttagtgaacacatctcacccctattttgatttacgaataaggacaacttaaaaactatcttctaatatgaaacaccttaacactaagaccttgcaaggtgcatctgttctttttatcctggagattaaaaaataatttacagacaaacagtttgggtgtgaaaatacttaaaatgaacaactttcattatcttttaagaaatcatgacggaagttctggtgaatgtctgtgctaacctgaagatattgagaaagtattttaggcagattctgttttatctgttacttcatatcatatcactcccttattcggtggcttaaaacaacgattttatttctcatgattctgttggtcaggagttcaggtggcttggtgggcagtgcttctggttcaagtgtgttgtttatcttgactgcattcatccggtagctggaaggtcaggaagacttcactcatatgtcttgtatattgttgctttttcatatgacctctctttctttctccacatgggtagtttgaacttcttcatagcatgggtcctagcatctcttaccaggaagttgccttctaaaagggattattccaagtaccgagggaaaaaaacccctgcagatctcttaagaatcaaccttaggagttatggagcctcttttctgccatatttccttggtcaaagcaggacacaggagcagcccaaatacaaaaggaggaaaaatgaatttcttgtttccataagagaaatggtaaggactgtgcagtcatctcggatccaccacagactatcattggctaaaacaacagaactgtatctggatacagacattcactataatagaagcatgtggatgatttaagaacgtttgaatgttaaaaatattataaggataaaagcgatgtcatgatgtcagtgctgtattcagccataatttttcaacacataccgttagccataatctatcaacacatgcagacaagttataatttatagaaaacagtctttcatgtgcagtgatgcttaaaaagataagaatttacattttcactgtaaaatagaaataaatataaagcaatcacctttatatagatgtagttataaaatatatttatttgagaataaatctaatgtaccgcttggttgaaaaagatggtatattccaaataatcttttcgcttcagggaaattatgaccatctagagtaattttgtgtcaaaaattaaaatatacagctagacttctcagaagatgtgtattttaaggaagggacaagtacacagaagttggttattatggccacaaagatactttagttgtgagatataattacattaatgaattctgccactgtgaaatccttgatgttgtcacatttcaggctggaagaagtaattgatctgggattggtgggattccaaagatttcacagaagaaagctttttcagatggttgggggaataatcagggaaaacagtctttggggttatcaggaatataatataattctctatgaaatatctttttaaaattattccagcccctctttgggcattaacagtgcatgaaagtatcctgttctcagtgatctaacctttttaaaggtactccaatgcaaaggactttaacgcaaagtgtagatactcctttctatggaatataaccctagtcatgacaagtttctcctttgtttactccttggaataagtgaaggtgatttaactcagagaggaaggtagggaagctatttcagaaggaagatacctccctaacctgagtgatgggggttacctttcctttgcttcccactcctccacattgcctgttttgcttaaaatatgacttcatccctttttcttcttttgttgtcatgggatattggaatgtaggaaccaggatgtcctgagtggtaaacttagctccactacctgagaaggacgatgtggcatacacccaccccatggacaacaggctgctgggactcctttttggaaacatgaaatatttacacgcacacacacacacacacacgtacgtgcatgcgcacacatgcacacagaggcacgcacattaactaagggaaaatttttactttaacacttcccttggaataataagccttgtagaactaattgtggccagattttattcaaagcagaaaataacatagaggaaaattacctactgctgtaatgtgatggttttgtactccaaaatgaacatgagaatgttcattcattttttagagataggttttttattcacggtataaattttgtggaaaaaaaaaatgtcattcttccaaactggttgtgacctgtggaatttgggaataaagccacgtgtgcattttaagcattcctaccttggtgctttgggttaaatgccccccagcggtcatccaatagaacctttttcttgcctccctcaggctttgaaattacctgtttactggtgtctctccatatacctacacatttcttgagggcagggactggactttcttcattttgaatcatcagtgaagagtttcaaaaaatatgtgtgaatttgcatttgtagtagaagtgctttgaagaaaagagagtttgaaatttaggagagggttccatggcaatctttattaagttgattggtatttataatatcttccagtctgtggatcgttttaaaggtatgctaggctagcaaagctgataaagtcagagtgatctcagattgacaggtgggataaataattagacttttggtatataactctcacagagaaaatctagagtgagttgatgcacagtagaaggaaaagagctctaaaagctagatcgaaagagctttttaaaaattaggaagagcaagcaaggaggaggggaatccagaggacaggaggatgtcagagggctgtgtttcatgggggcctctaaaagtgtccatggaaagaacgctagttgcagagctcctgggggagacaggaggagaggtgcacaagccaaactaacaggccagagtgttttgtttgcaacattagttttaactttaaatacagccagtttctttggactcgcagcccagacagggagagggaatagggaactcaacgacttcttgaataaacaattgcaagaaagtcagtaaaacccaatgagaccaataatgaccccacaaggtagggcctgatcctgtgggagattatgggtcagaataaaaacagttagtattttaaacgtgtgttcagtcatctgaatgatataaactttagctattattattatttcttcactataatttgtcaagtggaattcttttgctgcctgatgaagatgatttgtgcacttgagctgaccctgtattggatagggaggaagaagaggtcatttcaaatagaaggggaaagtaaagaaaagttgcgtgaatatctgtagaagacacgtgtgaaatcttatttcttctctttattggacttttacaagacgatggcagcagcagccagggatgcaacaagagtcacattcgctttgaaggctgcccttgaggaatggccccatttttcacaactgtacagaagtcatctctaggagagctgcagcaggcaaagccaagccggctctaattaatgacccaggctaatattggtctttgacgttcttggatattaataaatgttagataagaaaagcagctgtttatctctttgcccaatacaccttcaaacattcgtacaggagatagatatcctaatgtaaacatttgcagcctcacatattgtcgggatctctgaactgtgactgttgacagcaggttgccttaagtaattgcaatgagacagaataatctagtagaagctattgtcatcctaagtaatattttcctgagaaacagttatgaaaaatgaataatagcatttagtaatgcataatgtgagagtcaagaagaatattgaagacaaaggatacaatcatcattgcttgaggaaaactaaattttatatagctgtcctttgttgttatgttaatcaaattataaaataagcgatagtaggagaatagcattgctgtgttataaaattagttttagaattagattagttctgtgacatgagatggatcacagtgagattatacctcatgagtactcaactcttgtaaacactacaatgacatcgttaaatattccatgcttaaaacgcacagcacgttaactcctttatttcaggggttcgcttttatagttagagaaggttttttgtttctttttttttttttaacttttagactatacgcatacaatatattacaggtgcctgtgactcgctctaaaaatgttggaagctgaactgcatcatattcttgagggagaacttaatgtcaagaatttaaatttgcaacacccattaatgtgtatttagagcatttcaacaaagaaatacatttagtgacaaaagttttaaagtattacagaagagtcagaactgaaagataactcatggaattttaatgtaccattttaccaaatgtcctaaaaaatgatgagtactttcacaagtaaaaaagtacctaaaatttattattgttaagaaacattttatgtcaatctatgttaaaaccacaagtttgtaaatttctgaggaaaattgcattaagagtgtatggatattttaggataatgattaaaataatccaagagaaaataacataaatacagatatttaatgatatccaattcggcatagatggatgtggctctaattcagtgtggcaggaactccagaaagctaattttaacaaaagaatgtaatctgaacaatattaaacatgtaggtcactgtatttagagataatcactataattttaaacctattagtaaaggttgtaatgcaagtgtgttgtgctagagttctccaggaattactctcacttctctactgaaaaatattaaaactaccttcaaagataaagctgattacagcataacaaagcaactcactaccacctctacttcataataaatacaccccacattgttgtgttagacatgagtttcacacaatttattgattagttgaacttttaaaaagtctattatgttgacttcatgtctaacccttttataagtgagtggaaataagttcttttatttcttcccctattccctcactctcatcactgcggagctccgttgtttttattatcttattcattcctggtcttagttctcttagctttgttctgttttacgtgtaaacccatttctatgtggaagttcttctatgcagagagagcaggagtatattctttatgcttgggacaataaacatttatagactgaacattatacaccaggaattgtgctaattgctagatttacattgctggaggagacatgatagtcctctcagagcctacggtggaatacaaacagagcagcacagtgattttctgagtgtaacagagcatgcagtcaatgctctgggtgtcttaagagctttgcttagcttatccttggtggtagtagtggaggtgagtcaaagaagtcttcctggaggaggtgacctgtgacctaaaatgtgaacagcagataggacgaagaagggggaaggatggaaggtggtcatttcaagaagtaggaagcagcatgctcaaattgtataaccctcaactgtatagtatttgtggaaaaattataagcaatttatgtgactatcatatacagttctaggaggtggtgtgtgatgaggtaggaggagccatgtcatggaaattgttgtccttgtaggatattcacagcagcttgggctttaccctagaagatggggagacagttggagagttttaagtaggtaactggcatggctgactttacatgcatcattctgccagcaggacacagaaaggacttagaatagttatatgctagggtacagcctctagccagaggatgtcgacaaaggacctggactcaaatcatggtccacaattctgccaggttctagccctactgaattcagaaggtggtgcaaagattcttttttttttttttttttttttttttttttttttttgagacggagtttcgctctgtcgggcctgcggactgcaatggcgcaatctcggctcactgcaagctccgcttcccgggttcacgccattctcctgcctcagcctcctgagtagctgcgactacaggcgcccgccaccacgcccggctaattttttgtatttttagtagagacggggtttcaccttgttagccaggatggtctcgatctcctgacctcatgatccacccgcctcggcctcccaaagtgctgggattacaggcgtgagccaccgcgcccggccggtgcaaagattcttacaattcataaagagaaacaaatccagctatggagaagaacttactttttagtatagaaactttcagatatttatggacatttttcatacatactaaatcttgaagcagagagcgacaaagacatacatttgtgattcaccagcatatacatggtcgtgaaaattgtgaaagtggatggagttttttaggcttggtttatattaatataatgggaaagtgatggtccaggacacctaggaagtttgggagttcaataacaagggaagaacttccagagagagctggaaatggaatctgtaaattttaaagcagctgggaagcagggatgaaatataatgtagtgggtgggagcatgacaaagctcagtaggcctggtgtggtggctctcgcctgtcatcccaccactttgggaggctgaggcggtcagatcgcttgagccaggagttggaaatcagcctgagcaacatggtgaaaccccatctctacacaaaataagaaaaaacaaacaaacaaaaaaattagcagggtgtgatggtacatgcctgtagtcccagctacttgggaggctgaggtgggagtatctcctgagccctgagaggtcaaggctgcagtgagctgagatagtgccactgcactgaagcctgggcaacagagtgagactatttcaaaaaaacagagagacagagagagagagggagagagagaggcaaagagagagagagagagagagagagcgcactcaggagagaagagaaatctcaggagagaagtaagtttcaagaattttgctgatcaaggaaggaggaagactaggaatggaggaaacatgaaattcagcagactaccttttgaaaatttttgttttatattatttgtatgcttttccttcgtattttttaggataaaaataattgaaagatgtgtatgggctacaggcaaagagctagttgagactaagattggaaatatgggagaaaacgggataattaaagaatcagggtcctgggtgaatgtcaggtaactggatctttctgtataaagaagtttgggctaatatctagaactacattatggtaaattttcacggaaattaactcagagggatcatttccagagtaattttaagcctatagagatattttaagaaatcaggccatattttagggtctctcaagaaaattcacagaccaggtcataaaatacaataaacgaaatgttttctaaccacacataaagatccttatacttgcttataaaaagagatataggaatttatactacactgcaataccatttatcaccttgagattggcaaaatccaaaagtagtgaatactgtcatgggaattgctgttggaaatgcaaaatgctacacctctttatggagaggaatttgacagtgtctagtaaaattatatatacttttaccccttgacccagcaatcacacttttagacacctatttcacaaacctattggtaaaaatatgaaaaaaaaaagcacacctaaggctgttcactgtacgtctatttgtaatagtgaaagactggaaacagttcaaattttctttaatagtattgttgcacatctatacaaatgcaatacttcacagctataaaaatgattcagaaaggtaactatactaaattttcatcattatatatgtatacacacatatgtacaaatatacaggtgctccttgatttatgatggaattgttataaatagcactcgaacataaatttaattttctcagcaaggcagttttacttctatagaagggtgtgacttgcagatggaacaatggcaagagcacccctgaacaagggaggggaaggcgttcttattctactgctgtgtcattcccctgttgtctagggttggaccacacagtctaagctaatgccgattggctatttttaaagagatcaggggtataagccggagtggcggggtgagtagtttggcaggaaggatggttacagaacaggtgactcaggatgagccgggacagagcaggcgacaaggggtgactcaggtcaaagcaggtgaccaggggaacagatgtgaactactgattggaactgacgggaaagttatttactgaaactagagccaaggggtgaagagaaccaggaagttaaactttaaaatggagcatcaaagaataacagagctgaacatactgacatactgattctttgaagagaaacttggggttcactatatttaacaatcccccatcttgaattttttcagttctttctcttcagacttccttaacatgacttggcttagttgttctgcttgattctctaaaagaaaaaacttctctgaataaggtggaggagaatttagaattaataatgtggaggacgttttagtaagtgctgcctctatgagtctgcgccccagcccacagatgcatgctatgacacaacacccgagaagaacgagtacaccttctacgctgcgagagaagtaagcatcgaggctatgattcctttccatttactgtaccatttttctagccaccctgtgaaggaggcatttactcctcctgagtttttggctaactccttggacagagcagttagaccttgcaatgcctttgttatacttccatcaggggtggtattgtttggatgaaggtgcaacattgagttttcatcatgaggtaaactcctccgctttctgctaatatcatgtctaaggctcttctattttcccaagccctctggctggtagcccctaattgctcagctattcctctaacagcatctctactgtagttaataaaccactgttggtagtaataaatgtaatttattcaaactatgttcttattaattgtcacccaccaaaatattgacttaaatcctgcagctatttgatcttgggttttaaattcatctggtactcctcgtggaactccaatagcatctatgtaaacatgggggtcaaaggacccatgtgaggcacttcttctacaatttttttttaatcatgttgacggaatcctagggtgaaaggcatgaccagttgaactagagcacaagtgctgctctaattactcggcagagtacccagcaagagtcccccgcaataccaccacacatctgctaggggatgaacaagggcagactggtgggtaagctcttggaagggcttggtttcactgcaccctgttaagtctacaaggaatactcgcttttcccccggcggtgaaaggcacctgttgaagttaacatcaggggctggaggccagatggccctcgggggctgacccacagggttcaacctcagggaacagcagtgaaagagtctcgcatgactcatcgccccaggctgtggggttttggaagagagctaccatacagctcatgcccggtccgtgagagaaccgcccaagtggaaaggggataatctgggtctctggcctgcctgtcgcacataacagtcgcttttgtttagcgtgcgaacagaatatttaatccattccagccaagcatttgtgtcctgatatcctgtttcaattgctatagtttgtttcaaatttttaacctctacagaaactactttggttttatcattgggtttataacaagagaaggtttggttagcggagaactcaggagaggaagaaggaggtgcaggaggtgaggaggcaatgaagcacatttcaaaggatcctatggggtccttccctgagacttctgctcctatactatagaaatggcttaacgaaggggaagaactctggggagcagagatggtaatctgtactgggttacagtgatttatctgaccacggggagggctaactcctttagtaaaatgaatatatgtggttttaagaaactgcaagtactagctggggcggtccatccttgctcttcggtgttttacagagcattggaccaacttcggcagagaagctctgctctaggaggacaagatttccagtttacactggaattttcgtcaaacacttctcaaactaacttgtcccagttcacagatttttagtctgaggaaagctaggaaggataaagtacttttctgaggtggagagttgcctctcacctggcaaatctccacagggtataacgaggcaaggatcaaatgtaatagtttgaggcagaattgacgtggttacgttaataagtaggtgaccagcaatagagtgaggaaagaagaaggagtaatagaatagatgaaagagagttacatttttcttagctttagtttggtagggttttcccctaggactatggcccatgacttgggagggggcggcgctttcttgacttgagtattatgggtccatcctttttctggtgtccggactgtggtttcggtagttaggagcactaggtaagatccttcccaggccggttcgagcttttccttctctccagctttggatgaggacgtggtccccaggctggtgttgatgtactggaaactccaggggtggcacctgtgctaaaagacctttagctctgagggaagagaaagtggaagataaaccaagtatataacttctgagaaactgatcttttgtttcaaatgtcgggagatcagtagtagaatgtagataaggcagtccataaagcatctcataataggataggcctatgtctttttggggaacagttcagactctcaacagggtaataggcctttctactttccctgatgaaggtgggtgccagggattatgatattcccatattatatccagtacctgggctaatttcttaatggcacgtgcagtgaaatgagtcctgttatctgaagcaatgttttctattaatctaaacttgggtataatattttcaagcaatgtcttgactgcattattagcagttgtacttggaaagaaaatgtcttctacccaatgagtaaggtggtctactattactaataaatactttagacgaccaattggaggcatctctgtgtaatcaatctaggtactttggaatggccttaagcctggactccttcccccaaggggtaatcttttactaagcaattgtctgtaaccatttggccagggtataaatctctatgcacccataaactctgaggactgcatcacacatggcttggggcccccagtgggtcccttgatgcagttggaacaagatttacctcataaggggtttggataacatttctctcagtctagcaatatccagtttccttctgaattctctttagtacctatttttattagtttttagaccaaagaaaaccaaacagcattttatatttgacagtgcttcctgtatgatttttataccagataagctaaatttcacctttatattagtgggctattaatgttaaactcaattttaataaaaccttgtagacatatttatccaattttaatgtctgaccataacataagatttttatagactctttttaaccctttataatttttgttaaagagcaggttagtgctttaagaaaaacccattgtgctttgattttaataaaaaattaaaataaattttaatttattttaattaattaaataaattaaatccttttacacggaatttcctttacaattaacgtttcaaaacttgcttaaactttaaaacaaaaaaaaaatttttaaccttttaatgtaggtatgaatccacattcttatgcctccttacaatccttttaccaaaagtatattttactttccttacacaccttgcaaataaactgtttcttcaatagttttacattcaggaggccgaattacttttaaattatacaacatttcttgcataaattcccttttataacatgtttcacaactttcacagacaatctttgacatgccttaactttttgacttgttgtaaacatccctttttttaaacaaccagttaatttactttcggacaagaatttaccatgtaagattctttttacatgaactctcctttttttaatgtcaaagatgataacagttcttttccaaagcaagcttcctttatgtctgtggactagactgcctaagaccaccagattagaagttaggataatacatgttacagtgttaacttttagcaaactttacttttgttgaaaacctgtaagtttgggattttaattaaagaaaggcttttctgatgtccagggccatggacaatagctgttccttttggcaagtgaagattatttatacgtgggtgattaattccttgtggaacaggtcttggtctttgctattaataagccctcattcagtccaaatttttccaaatgtatggaccactcaaaaggcgtacttagaatcggtaagatggttccttcctggttctctaagtactttaaatcttggctgagtgcaaacagctcacatgtttgagcagaccaattattaggcaattttcctaactctatttctacaagagtttctctatcaattattgaatacttattgtgtctttttccctcaatcacccgggaggaaccatctataaataagtgtcatccagtcctgaagggagtttctcctaggtctggtcgggcctttgtatggtaattaattaaatctaaaaatgtgtgctctctcttacgatttggatcccctgttaggaaacctgctgggttaagtgaattatcagtggttaatgttaaatcatctttttctaacaaaatagcctcacactttaagatttttgggtcagtaagctactttttggctttctgacttaggatagttctgaccttgtgaggtgtgctcacaatgaagtttcctccaaaagttatttttctactttcttctgttagcaaagccgttgctgctaccgattgaatgcatttgggccatctgcgggttactgggttaaggagtttgttgtttttttttttgagacggagcttcgctcttgttgcccgagctagagtgcaatggcgtgatctcggctcaccgcagcctccgcctcccaggttcaagcaattctcctgcctcagcctcctgagtagctgggataacaggcatgcgccaccacgcctggctaattttgcatttccagcagagacgggatttctccgtgttaaggatttttgataggaaggctacgggttgccagtggccttcgtgcttttgggtaagtatttctaaggctacgcacttgtttacactgacaaaaagatggaatggctgcttgaggggaaagctaggacaggggcagttactaatagatgtttcaacctttccatctgttggatttctggtaatggccaaacgaaggggtttggcccgtcttgcgtgagctttttgtataaaggctttgtttttagggcataagagtctatccatagacaactgtacctgactaattctaaaattttttaagttcacagtgttctgtgaacatttgtggaatctacacggcagaggactagaatggacatttatgagtgatgtttaacataacaatgccacctgttggatacagtaggagattactctgtgtttcatattcttagacactgatctcagcagacacagaatctcgggtcccctttggaaaacagcattttatgaagagcctttgatgcattatgcacaggagagaaatcgtggcggtgaatttcctagtgttgggttttgcctgtcagataaacttaagctgggacagtgtcttttgcagatttggggatatattttggacattcagtgtgcgctcatgatgatcactgactggacaaacttatgctgatgagtcagtattgttattagaagatgagaggggctctgtaatttgaaatctattttctactcctgagacattgaaagggattccaatttggattcaatgtgggtggctttcaagatagttcttttaagatcatgtgatctttgcccttctcacagtttagtgttgtctatttttaaagggtgttaggagtaaatgttgtttatgtttaagcatgataatataaccatacctcaccgccacccctaaaacccgtagagacgaatacatgatagggattgcaactgtggaaggtaaacaaataagcaattttgctcatttgttttttaaaagtgtgactatttgtcttgatagtaataccttgagcttgtgcttcaaaaatctgtccagctattctcttctgcagacatattcacactctcaagcctgcttctgttaatgtgtttatgtgattgttctaacacggtgaatactgcttttgactatatgtacccagaaattattattacatttttttgtaatttacagaaattattattactttttttgtaatttagataacgaaccaaacttgtggaccttttttgttcatttagaagtggtaaaggttgttccgtgccttgacagaattcttaacagctgcctctgccttggttttgctttatgcgcttccttccctcaatggccatggcattgtatttcgggacactcttccctccacaaagcaacagggcaattcttcagtggatattagaatttttctcttctttttctgcaaaccctgatgcacccatacacagcatatcttttgttttattacttccagtttggtgaaaaactggatttgtcatgacaaccaagtatttagtggaacagaagcagagataaagaacacatcttgaaaggaatacacaggatcaatatttcatgtccatctgaagtgttttcagtgttgttgaggaaaaagtatacatctcattgaagtgtcctttttttcccagggaccagatgttcattttatttatcaattgtggacaatccgtcaagcccagcaatatttttccagagatttccccctgtggttttctaatttatttgatatttaggaaaagaagaattgcagctgctgcagaagaattagagttcaacttacgtgtatgtgatcattggagcatgttcctccgtcagacattaaacgtttaacaggacacagtaacttatgcttcgtttgaattttgcatctgcctgcttctcctaactgggtgaagaatgctgacaatgacctactggattagttattcctctcctctattttatgaaatatttcatattttatatttcaaaatatgaaagcatattttaaaattactataagactatatttattttagatactctccacataattagtattgcagagcttcctgcttcaaaatgtatttgtaatttttttctaattgcactgacccataatagctaagattgaacctacatttaaaaaatttaatttcccttcatgttagtgggtaactataaccataaaagagactctttttttaaaagattggacttttacatttattaccactgtaagtgcaatgagataaggcctctgaccatgttcttttggagattgttaaggcattcatgaatcctttggagctgtcagcctgcacttctcactttgtcagaacatatggatgtgtgggtgtggtatgcaagctaactgtcctgaagaagcttgtcaaagaaatgtttggaggaaaaaacaccataacactgagcataagtttgaatatagccatatactagaataaaatatggatatcaggaaagagcttcctatcagagattgctaacattggaacttaaattgcatcttgaaaatggattaataaggtttagcccagtagtggtaagttggtggacattactagtgggtaaacattacatgggcaaaagttagtaatggaatattgaggaaaggagtctgggctgaggaaacgaaggagtaggcaaggccgggaggggtggctcacgcctataatcccagcactttgggaggccgaggagggcggatcatgaggtcaggagatcgagaccagcctggccaatatggtgaaaccccatctctactaaaaatacaaaaattagccgggcgtggtggtgcacacctgtagtcccagctactcaggaggctgaggcaggagaatcgcctgaacctgggaggcggaggttgcagtgagccgagatcatgccactgcactccagcctgggtgacagaatgagactccatctcaaaaaaaaaaaaaaatagaagtaggcaaagaggagaatggaataactggagttgggaatatggactcataaacttacctttaggaggagttactaggagagtttcacatcagcagtggtctaatcaaaaaagccaattaactccagccatttttagtcactgtaatttggctccaaattcaagttttagggtaagatatcttattggctgtatcttcaagttctttaagcattgacatcagattttctgtaacgcctttagagcctgctataaaccctaatagatgactttatctgggtagctagaatttgagatacctgtgaatcttggctgtaaaatttgactcaatttgcatcccatttggatgaagcaacaggatattagggttttgaagtatgcttatgaaaataaatatgctatgacgtttgtaattggtatgattcagaatttaattagataaactacctagcatttctctgtattttcagaatcttattaccaacttttgtagtactccccaaagagcaatttcagtaatttgtagtgtatctctggacgtgataaatgctattatatcactgtgatttgtaatagcagtgcttttcactgtgaaagatttactgagattttctaattgacttagagcattgcctctcaaactctttctctatttcttattcactgtactttctcatcacaacttagtaatcatattaatcttgctttcttggaaatgattcatatatttgcatgaagactaattaaaatacatatgcctgtcctaaatgattaggctaagacttaaatgagcaactctcagcttaaaatcctccagtgattccccagctcgctcagagtagaagccaagcctcttataataggtcgtaacaccctggtacttttctggattcatctcaaacaccctcttactaataccactcagctttatggcaccacttttggttgtggtgaaggcaccaacaaaaatgtttattgtctgaatttggcatgtgtgtgtgtagtagtgtatgtactcacatatctgaaaaatatttaccctttaatataactttctgtcactctgtatatacacctccagattcctccagttcagacatgcatttgcctttgctgtttcactggtctggaattatcttctctcagatttcttcatgtgttactccttcagcttcttaaacacgttgatcaaattacttccagtgattctttccctagagggatttacttaaaattgcatcactttttacttatttattctcttcattgtttgtgtcttctctctgctcatccccccagccccacccagacttaagatcagtgaagaagattttttttcttgttcctttacattactaaatctccagtgcctatgtcaaactccagcatggggttaataaatgtatgtagaatgaaggaaagcctcttccaaatgagtgcttaccatcattattgcctctcaagaagtagatcttaatatgaaaaaggatgggaaagttctccttaccttttcttctaattctttgccatgcttgaaacattaaatggaaccaaatttctagatttatttctatttacatctccaaacatttgcaatccttataaaaaacatggtagaggctaatcatgataatgtagataataatagtagtagtaataataatagctaacatttattgaagacctattaaagttcagatataacttttattatatcattaacaaatgttattaatttaataaaacctgtaattaaatttttaacaaacttcaaattcttgatgagcaactgagttgataatcctatttgcccattttgaatatgataaaaaacagccacacttacagtaactttatttatttgtgtgcatattatgtatgcattttttctgcttgggatctgttgtgtatttgtatggggattttagtatatgtagtgtagagactatcactgtcaggtaaattctgttatttcttttggagcctattggcttttaagcactcggcatgaaatatatatttcaaataactattaagttgttatcatctgacttttttaaaactttctacattaagggacttttcattaccttatttgaactactagttcttggtttgaatgtaacaaattcctgggaggcccgttttgaccgcaaagaacaatgtagcactatcttttttaaaataacatacctacttaccaaaagaattgggagaagaaatcttgattcatttaggattagactaaaaagttacattactttttcttttattcattatctttttgtttatagcatgtatcaagactgaagagatgatgattttaaaaagataggcattgtattatgatttgctttttcttcactgtttttataggatgattaaaaatatctggatttcataaggcataattgacaggttgcagatctgagttggagcacatatcaaataatatataaaaccttctgcttgatacttttgagatcaaacattgtcataacacccacagtgttttaaaataggccagaggacagcctcctggatagctgacctttaaccaacaggaagtatataaaatatctgcagagtagaatgactatattccaaacttagattagacagaaatgacaccagctctgggttccatcactgtttctgtgcatccgttgttgcatctgagaagcagagtgctttttgttcccccacacttcatctagtttgaagcaagaaaatttaacagtgcaacaaaacgaactgccttttccagctgaactctatcttctctgacagatggttcggttgggcgtcttttccatccagagcagtgctgtgtttgaagaatgaaagcattgagagagatcatttgttgtatagagcagagtttcaaataaccattactactggcaatctctgctgtaattcctggattttgagataggtgtacaaggaactctgtggtgagattaaacattcagctaatttttttttcccccaaagtcattaagtagctagcatttaattttttatatgtgcagattaaaaatgaaggttaagtaccaacaaaggaagctccgttcaggaaaactctggtatactctttggtgtctttggtggaaatgactattcattatgcggaagaataagactttataagaatagtatttccctaagcaggcacagcacttgagaaggttacagaatacctgtttactctgctaacctaattctctgtcgatttctcttgtcaatgccttttgatattttgacacagaatgttctacctaggaccactctgctgaatataggtcaggctctggactctttctgaacctattctcataaatcgcaattttattactgtttatacttgtctacttgagtcattccacacaatgggaacttatttttaatactaatttaaaccgaggtgctactgagtatcttgcttaacatatttgcagttcctgaagacttcagagttttatcccaaagaaataatgctcatagagaggaagcagatatactagttattccttggaagaggaagaaaacaggaaatggatatttggaaacaagagagacttccatgttcctcaattcatagcaattatccagtcctactttggatcatcctcctaatcctattaagaaaataaatgagactccaggcattacaaaatctgaaaggtttttagaaaaacaagctactctgaaagcgtatctttggtcaacacagccaaacacaactcacagttttaaaaacacagaaccggccgggtgcagtggctcatgcctgtaatcctagcactttgggaggctgaagcgggctgatcacctgaggtcaggagttcgagaccagcctggacaacatggtgaaaccccatctgtactaaaaatacaaaaattagccgaatgtggtggtgcatgcctgtaatcccagctacctgagaggctgaagcaggagaattgctggaacccgggtggcagaggctgcagtgagttgagatcataccactgccctcaagcctgggctacagagtgagactctgtctcaaaataaaataaagtaaaataaataaaaacatagaaccatttggtgattcctttagagacaggtcggatttttcacatcacttcgcagtcgatgaagccttaaactaggacctactaattgtgtctagacataaacagaagaggaaatgagtccaacaagaggaaacaagaatgattctttgtcaagtacactatttcttttcaagagctcatgttatcctcaagttatatggaaatcctttcttgaaaaatgactccacctcctgctctgtatgtgctcccagcccctccttccacagtggagcagtaagagagtgaaggctttatgtgtcctcaagagcaatgattttgcaaattcagaattgctacttcctcaggaaaacttgaagttaaaaaaaaaaatccttatttgaagaaggaaaacattagggcattatcgggtgagaacgtctctcatttcctctcacacattagggtctttctttgaaaagtagtgtttttatgtcttaggatgagggtactgcatgattcagggttctcaattttgtgttaaattaatatctgtgcattcttaagatgctatttatcaaggtggttttacatttgatcagaactcagccacagatgcattttcattatttatttttatagagatgtagtcttgctgtgttttccatggtggtcttgaaatcctggcctcaagggatcctcctgcctcagcctcctaaagtgctagaattacagacatgagcacccatgcctagcctacattatataattaattaaaactttaaagcaataaaggctactgaattttaagttaagcaattttctatgacctagaaacataaagtaaaatcactctagtttgtcacaaaatgaaaaatatatgctaattaagaatcagaaaatcatggctttatggaattgaacatattttcaatttgctgattaaactccctgggaattttaaagtcatctaattcagcttcttattgagaattttctcttttaattggacagctttggtctaaatacttccagtggacctacttgcctctacttttcgaggaaagtctatatcagagacacttgtattattttaatgtgtttcataattttgagaatacaaaattggattctgcatagctttacttgcttttcatatttctctatgtaatggggatatttttgaattctagagcagcactgtccaatagcactttctgtgatgagtaaatgttttatttctgtttaatatggacatgtggctaatgagcactggaagtatggctagtgtgactgaattactgaattttggatttcatcaatttttaactaaattaagttgaagtagccacacaagtcttccatatcggcatagttttagaaatattgttttcatcaaggacagagaaagaagaaaatacctttctcttgtttgactgcctaatgggcaaaattccttttacaaacgttgagaaacaaacaaacaaacaaaaaacaacaacaacaaaaaatcttttggagttaatgcttattttgcatagaaataaaggcataaaggaaatttcaatatatggccaactcaagtttagaaaacagtcagctctctatggtaactaaccaaggaagagatgaataaggaaggtgtagaaggtggggaataagacctgcttaccagcttaaggacaactgaaaaatgacaagaattcaactgccgtgtccaagacaatgttttctgcaagaatgagtggattttaagtacaaggaagagtgttggcttgagtctggtcttactatgtttttccctctccaaccttattttttcccaggttgttgacagtgtgtaatttcaatagatgctcggcacttttctcacatctccactggagatgagctttatacaagtgaaagtgctactgagatgggaagatgttagataatggcatacgtgcttcttttttaattttttctatgatttgcctccattccttaggtcagcatgaacagattggagagggagatgctgagtgtgtcatactgaactgagctaaattgatcagaactaagggtgatatgctcccaaactactaccctatcctatttacagcttcatctaactagtgaagtaatttttctacctcaggaaaattaaaaagatccacacatacacccccacacccagacatacacatagacacatgcacacaaatccatgaagttggcactttggctttgacctctcatgatcttcttgacctctctatgatctgcctcagcctcattttccctgtccaaacacaaaatattttatactatccaatatattttattatggattttttcttgttaaatttccttttctcctatctattcaatcaaaattctttccctccatggagaggtttccctaacaatagacttctacctaattttcatattaaagtaacttatacttagttgtgaggaagttctctaggttaagaataaatatcatagagaaactttattgtcaaatgaatacctaaatgacaaatttctgtggcgatgggcgagtttaagcagaagagactccccctcacgttctatgaattttcttcagttatcctgatttgacttgattttaggctacttgtgaagaaatagaaattttactaattagtgaaatgtcttctacagttaaaaatccattaaaccttttctgtctatttctgatgtgcagttctgcaaaaactgggccctcttaaaaggctaagtgaccgcttttagtttaggtgagatataaaaacacaagtagcaaagaaagtaatttacctttgtctagagaatttattctctaaatatgcacaaagaataggccatatgtcagactttgtccttagaattcacgggaagaaggaaaaagactaagcctctagcctcttgctattgacaagagcaatagatactacatggattatatagaccttgcatgcagttgtgatgaattcgttgatagtaacagaaaaaaaaatagccttttgacaatgccagcactttacaaaacattttagtcacaactctaatagcaaaacaaccactaaagcagatgttaccaccctcattttagaaatgggaatctgaggctcagggaaatggcctctgtggatgaaaactttaggttttgttcctggcagtagtaacaaaaaaccaaactcactaaacaggtcataaaagtaaggaagcaactcagtttcatctgtctgcctgttctgtcagatagtgacagctcctcccgtggggagcagtgaatacatgagtgagaagactttttaataacagccattctgactggtgtgaaatgacattcattttggtattgatttgcatttcgctgattagtgatgttaagtattttttcatgtttctttggccacttttatgtattctgttgagaaatgtctgttcatgtcctttgcccattttttaatggggttgccttttgctttttgatttgtttaagtatcttatacattccagatattagatctttgttggctgcatggctagtgagtattttctcctattctgtaacttgtctgtttactttgtatatagtttcttttgctgtgcagaggctgtttagtttaattaggtcctacttgtcaatttttatttttgttgcagttgaatttggggacttagtcatagattctttgccaaggccaatgtccagaagggtatttcctagattttcttctataatttttgtagttttaggtcttacatttaagtctttaattcatcttgggttaacttttgtatatggtaataggtaagaatttaattttattcttctgcatatggttagccagttatctcaggatcatttattgagaagggaattttttctttattacttatttctgtagactttgtcaaagatcagatggttttaggtgtgcggtgcggcttcagttggtgggaatgtaaattagttcagccacagtggaaagcagtttggaggttcctcagagaactaaaaatagaactacaatttgacccagcaatgccattactttgtatatacccaaaggaaaataatttgctctaccaaaaagacacgtgcatatgtatattcatcacagcattattcataattccaaagacatggaattaacctcggtgcccatcagtggtggattggataaaggaaatgtgacacatatacaccatagaatattatgcggccgtaaaaaagaatgaaatcatgttctttgcagtaacgtggatgcagttggaggccattattgtcagcaatttaacatggaaacagaaaatcaaatactgcgtgttctcacttgtaagagggagataaacattgcatacacagacataaagatgggaacagtagacactgggagctggaagagggggaagcagggagtggtacaaggattgaaaaactgcctttgaggtcctgtgctcactacctgggtgatgggttcaattgtatcccaacttcaccatcacacaatctatccttgtaactacctgcatatgtaccccttgaatctaaattaaaagttgaaactaaaaatgagtaagaatctgaaaagaggaggagcaacttctcacttcagggaagctttcttatgggagtatgttttatacacacatatacatggtatgtatatatgaatctgttttatgaacatacacctatttccttacggactatgaggacaagaaaatggtgtttccctcgtcaggtgactgggctgctacttggatttatgtttggtaaatatgttagtgtgagataatgtaccatacgcctccagaaaccaattttttaaacaatctatagcaccataaattagcattttctagtgtgactttcaaatattaattactattctctgaaaaaaagtttcatgaagagagttcagttcacagagtccaggtacatgtgagaaactgccgagtaggttccttcctcaaaactctgagaagcactgcaatagaaaaaacatttgattttgcttaaagcaattttccccatatttgacaacaaaaccatgtctatttgctttttttctcttccaaagtcaagctattgacatatttgttctacagaagacatctgagaagatttttattaaaccaaataaatgagtaacatggaaaatttgagcatcatagtgggattagagaaacatttttggcaggggatgggttgtgggcaaccattttattattccatttagcttggtttactcctctatttattgatgtctggtactgtaagtgtataattatttagtgttcagtaaatgctaagccatattaaatggtaatggtaagattaagcatgtgcatgctatttgtccaatctagatacaggctaggctcaaagtatgatgtaacttcagccatgctgagggttctataggctttaatattcttcaaagatgttatcataagacctaatagaactagaaacagaacatgaataaaccaatatgactgtattggagatttttccgattgtcaacaagtgtttcgttgactgttccagacttttaaaagtgctgtaacttcaacatccgaatctcctttttgtgtgcataataaacattcctgctttgtgtaattttaactagaccaaacgatgcttacacttcccagataccagctgttgaagcagcaactttcaaatgattttgcagatcggcaaacacattatatcattgtgtgttttgcagctgtctcttcagttagcctggttttgctttttgcagagtaacttgtgtacagttacagaagagtatttgttttcctccaacagtcttggcaattagtgctttcctagcttcagttttactttggtgcaataggcaccctgtattgtgaaccgtttataaaccaaggtaatgacttgtgggtttttaaagagtgcttactgcaccaaaaaaaaaaaaaaaaaaaaaaaaaaaaaagctttctcctggcttgagtgattttaaaaccgtttagtcaaatgtttgagtgcctattgtgtttaaggcactctgtaagtgttttgcatccactgagcaatacatagtagaagttagttgtatcacacgtagatgggaaggttattctaaggaacaccacttttcaaacgcaagagagcatgtccctgtgatgccacagagggaaactcagtgagactagagcagagtacaaaatcagagtatcttatggtaggcgtgcaagaagtagattgcagaaagctatgctaaagagtttgtaaccgaattgaatttggaatgaatggaaatcctttggaggattcttttttttttcagggttatgcgaagatcagatttgtgttcttggtgaaagatcacacagtatagtagagagaatgaactataggcaatcacattgggtgcagggaaacgagtaagcatactattgcctagttatataacaatagattggcaaaactggatagtagagacagtgagtcctagttagttttcttaaatgaatctattagccgatgtacagatattagatagaggacgatagcattttagagctggaaaatccactaatctaagcccattgtccaagatatgaaaactaagtcttgggccaattgaataatcttgataaaagctttaaagctagatagtatcaaagctagaatcacaatccacatctctaaggatactttgctttacattatttctctttttttttttttcttttttttttttgagatggagtctccctttgtcgcccaggctagagtgcaatggcacgatcttggctcactgcaacctctgcctcctgggtttaagcgattctcctgcctcagcctcccaagtagctgggattacaggcatctgccactgcacccggctaatttatctcgctatttttattttgtattttattaactttatcattgagccttaactgcatagattaaaagagtaacttcttttaatgtaattatacattgctaaaatgaggtctcatagcagaagagaaatgtttaatggcagcttcctttacctcttgctacttgactttgagcaatgcattcctttagactcaaaatctgctttttattatttaccagtctcccttatctgcattattcagtgtgcaagtattgatttccacttatgttccagggactgtagcaggtgttgggtgaataatatgtggaaaactctatccttgaggctgttatggtgttggagaaatggacaaggttgtgggtggctctgcaaccacagtggcaggacgtcctgcccttctggggagttcaaaatggctttctggacatgaaacttgattaagagcagtgccaacatcatcgtttcaaattatctggaagtgtacatttaggagcaaatgtacaaagctataaaaatattcataattcttttttacacctaatacttgacccttgtgcttggctctgacgtgcttactctgaaactcttttgaaattggctttgtgtgtagacaacagatgagttctcagatcagaaagtaagtaaactggcatgatgttggattttggctagctctaactattaagtagtgatgacaagggtactcagctctgaagcatttattttttattttagatgacactatcttaatctcaaaaagatatcctttgacttgaacacctttcctcaggtttaagctgtaatcaagttaaaaaaaagtcaaacattctcagtttcaggaagatattactgctgtctaaaacctactaaaacatattttgcctatccaaaaggcaaaatatgtctctgaagggaacatgagcaccttggcagaaaatgaagctatttataaatcttattttctttactctttcattccttagttgtttttattggtcatatttaagatatggacatttttaatatatgtacactcacaaacatatatatgcacaaacatacatacacatacatgctatgaaataatctatagctaagtgaaacatgagacatctcagcatgtgaaactgtaataatctcattcagttaccttttgctaaagtagactttattcttttgcatttctattatttctttcttattacttttctttgtttattctaactttcttgttgtctgccttgctttaatcattttgtttcttctctttatctcctgagcaggcaaacaaacctctgggcaatgtggtcttgcagctcagaacagcaaagaaaaaaaaatatttaactcgataactgcaaagaagaaactgtgtttcctgggagaggaattattgccaaagtagatgcaagaaaaatcagctctggcagagacaaggaagaattacacatatgtcttaagtttatacttcctagatttctatcacaatgatagtaacaaagatgtgaaacacttcatttctataatatcttaagtaggccaggttcagtggctcacgcctgtaataccaagcactttgaggtggaggattgtttgaggctaggagttcaacactagcctgggcaacatgagtcgtcttctctttttatttttattttttatatatattatactttaaattctagggtacatgtacacaacgtacaggtttgctacgtatgtatacatgtgccatgttggtgtgctgcacccattaactcgtcatttacattaggtatatctcctaatgctatccctccctcctctcccaactccatgacaggccctggtgtgtggtgttccccatcctgtgtccaagtgttctcattgttcagttctcacctatgagtgagaacatgtggtgtttggttttctgtccttgtgatagtttgctgagaatgatggtttccagcttcatccatgtccctacaaaggacatgaactgatcattttttatgggtgcatagtattccatggtgtatatgtgccacattttctttatccagtctatcattgttggacatttgggttggttccaagtctttgctattgtgaatagtgccgcaataaacgtgtgtgcttgtgtctttatagcagcatgatttataatcctttgggtgtatacctagtaaggggatggttgggtcaaatggtatttctagttctagatccttgaggaatcgccacactgtcttccacaatggttgaactagtttaccatcccaccaacagtgtaaaagcattcctatttctccatatcccctccagcacctgttgtttcctgactttttaatgatcaccattctaactggtgtgagatggtatctcattgtggttttgatttgcatttctctgatggccagtgatgatgagcattttttcatgtgtctgttggctgcataaatgtcttcttttgagaagtgtctgttcatatccttcgcccactttttgatggggttgtttttttcttgtaaatttgtgcgtcctcttctctattaaaaaaaacttaattagagattctaatgatacagagaggaagatcaaataagtcaaaacaatactattgagaaatattcaagacatttatgttttaaggtaatttgtttattttgccaaaagcaatacataattatttgatcaagcatataaatctgcttcaatttttgtattatattttaaagtttaatatataacttgaattgtgctactccctgtgaagttttgctaaaatatttaattattattttacaaaatgtattgttttgcaaaatgcaaaatctttttctcagaaagttgagttgcttacttagtttcttttgttggtcttactgatttttttttttttggtcacatattttagactttgtgtggcccagatgataagttatcatttctcataggaaatcatatggcctaaaccaaaataaaacaaaagaataggaagtctgtgagacaaaacatggaagtcatttagcatagataatacctaggaaggcctgaataaattgccattggttacttcttaccagtcctacaagttttactgtttctgcttatgagagtagtcatctaccttccatcatcaatgcaggcatatattggatttaataacatttgctcttttgcctattgaattgtattattgctgacatcaaaactctcctaataatgtttttttttcttttctccttaaaatatcggctctgggaggacacttacccaattttctttcatttaatttggcagtaagatgctaacggtccttttttattgacagaagcaataacaattaatacaacttcagtgcatcattagttgacatgttttgtccatatattgtttcaaatctctttaagaaacaaatgatatccatatttgagttaaatacaatggtagataaactaagttagagatgtgtgcgtgtgtgtgtcagccaatactttgagtgttagaattgttttcctattcattattttttgaataaacaagtaaatgctagttaaagctatttgatgctgtgactgtttagctccttatgcaaaagacaggtcaacacccttggatttgttgagttgactgtgcattcagcattatgcaaagcaatgacccagggtgcatgtcttagctctgaccttaacctgcagttacttctcaatgaagctctgatgcctttgtcaagtacttgtactttatccatagattagctaattttcaagttgtggggttaatctttatctgtgttacctttaaactaaacacttactgttccctaaagcactttagtgctttagagaacatgctggagtgaacctccctgcctgaatctgttatgtcatgacccttcattacagactcttttgaagatgtgaggcagttttatattaagcaaagattatcggagcagcctgctttatggaaagaatcaacccaatgtacatgacatgcaccagtgtttctctttgccaaagggaacacactagtcactcacattagagatggccttaagttactatagtcaaaatactccactttggtctgtattttctttaattcagtgtaaacttttgtggagcatacatctgaaaagtccatgctggcactcagagagttactcttttagcgtatgagacagagtgatatatgttgcacgatatttttgtgtttagaatggtcatctatggaatgagattacagaaccaattttctttaatttaaaagaaaaaaagtatttaacctacttgaaacacatacaaatatgttaaaataaataaaaatagttatttatgtgtatttgcacacacaaatagataaaatattaccttgacatattttattatagcataacttgcatcagtatatgtgtacatatacatattggggcatatttgttcataaattcttaaagtagcctggttatgcatgctctgtcttaaatgagtttaatatgtcattatttcactttgagaaatgcatagttattcacattggtttatcacatatggagttgaaagagtctattttacttctctttcaggatcatacaaatagttcatttatataatcacaaaatggagatccactccatgattggccctgcccattaatattgaattttcatcacgctgttattctttacgtgagttcttaaatataaccctggtaagggctataacatgtacatttgaaaggattataaactgtgatagtagaaaattctgagagaattataggaaagtcttcactgaggactcactggagatagctggggtgtatatctccccttgccctaggaggatatcttgcatttttactttacatattttgtctcagaatgagtaaaagacataccttagagtaggatgcaacagtgttctcggatagcactaatttagaaaaaaactgggattgtaaatgcaaatgtattagagaaccattttgcaaatctcttgcttgtaagaaattccccatatttttgccccatgtcacccatccatggtgattaatactcatccttaagccttcaggttttgtcttatatcaggtattcatggaacaatgtgtgtttactttatctatctccatcctgactgatcatatactgcttaccttcgctctttttagactaaagtctttttcttttctatttatttgttcctctgacactatttttctatgcaattttgtttgagcctttctagtaggggagaataggtctacattattgtttataatttcttgtgatcattccttgattttgcttttagttgtattactgcagttaatatttatgtttactaatatgcatatgcttaatcccaaatgatactaatatgattcattacagtgtacagtatgtcaagatgactggcaggtatctgattcctaagtactataatgagaagcttaggcctatagtacttagactactgttatttcagtacctactacaatcagtagatttttaggcacatttaagagatttatacactgactgaggttcctaagtcactgtttattttatggaaatagaggcaggatttatggatagaaaaaatcagaaaaatgctttttttaacccataaaattagagtaaaataatttttataaatctttaatatttagactttggttttgtagataaattctgtgtttgagaaacaagcctttcgtgggttggggttgggaagcagtcctggggaggaaacataatatcctggcaaatgcggccagtggcctggagagtgccatgcaaattgagaactgagagcagttgtggatgtggaatgaataggggtttggtctgggtgccaagtcaatgtaaggaatgaaagctacatcccatgaagatagtttagtgacaactctggctttcagcaagttgatgaaaagctttattattctaattctgctgcaattgcaggagtcccttctgtctgggggttaagcttacccaagagtgttacttcatttccaagtctaagcattaggttctgatacatggtatgaaattgttaaactctgtggattttaaatggccttttgaaattatctgtatcaaccgaggtgatgttaagatacactgagatcattttcaattaattgtacttcagccgatgttgagagggagcaggtagggaaatattgatcaatattgccatggggtatacattttatatatgaaataattacttgtgtcactgaacatgtgtttgtctcaaagccgtatgaaattgtcagaatctgtccttttttctgacttctccctttattcaataacactcaatgatcttatatcattcttaatgtgagattgacttttgtctctaaggaatgtaaaagttagcctgattttctgtatcaactcatcacaggcactggcattcccatacctctcttccaactgagttcttgcttgcttgacagaattgtgagccccttgcttcctttgacccccaggtttcccaatccactcgaattgacaatgcctttggctctcatttttttatcctagcacatcttgcctttcctgagcttgctgtcctgttggcagctagactgctgtctttgttgttgataggacacaaattgggaaatacagggacaaaaattttaacctgctccattacccaataggtttggttttttaaatctgtatttttacttcatacaaggtaatttgcgttgtgacatacctatatggtaatgactgtttggtgggtattttcaatgttgattttccagagttgtcttagaacaaaagtgttggcattattctgtaggctggtaaatacgttgtgcttccatttatgtggtttcaaagcataacttatgatatttgtccaaatgaagaaatatctttgtttgtttttatccagcaggaacttataacttatttcaataatgaatttttaaatttatttgaccaatatgattaacatattaagttctgattttaacaccaaaaaagaaaaaataaaataggccatataattttgagcatttgtgaattttatggaaatactttaagttttaaagtttttaaataggccacatgtctagtattaaaaatagttcacatgtctattattatttaagtcaaaaattacagaagtgggcaaagatgtggagaaaagggaacatatacatcattggtgggaatatgtattaatgcaacccctattgaaaacagtatggagaaaaattacagaagtgggcaaagatgtggagaaaagggaacatatacatcattggtgggaatatgtattaatacaacccctattgaaaacagtatgcagattttttcaaataaccaaaaatagaattatcatataatccagcaatcccattactgggtatccacccccacagaactaatatgatccagcaatcctattactgggtatctacccccacagaactaatcatggtatcaaaaacacctccattcatatgtgtattgcattactattcacaatagcaaatatatggaatcgtgctaaatattgatcaaaggatgactggataaagaaaatgtggtgtatatgcataccgtggatactactcagccaaaagagaatgaaattatgtcttctgcagcaccatggagggaactggaggccattatcttaagtgagataactcagaaacagaagtcaaatatcacatgttctcacttatatgtgggcgctaaacaatgtgtacacatggacagaaagagtagagtaacagacactggagactcagaaaggtgggaggatgggaggaaagagggagaaaaaattacctaatgggtgcaacgtacactattcaggtgatggttacactaaaagcccaggcttccccactacacgatgtaacccggtaacaaaactgcgctggcacaccctgaatctataacagtgaaaaaaaatttaattaaaaaagtaggccacatgttgtttcagctgatgtttacatggaaaaatttgaatctcccaaggtctctggagagataatggaacttcaaacatttcagtgactgattttataaacgcatatgtacgtaagtgtgtatgtatatatatgtctaacttagcataatcaaaaactaagtcaaggctgggtgcagtggctcgtgcctgtaatccaagcactttgggaggccgaggcaggtggatcacctgaggccaggagttcgagagaagcctggccaacatggtgaaacctcatctctactaaaaatacaaaaatcagccaggtgtgctggcgggcacctataatcacagctactcaggaggttgaagcaggaaaaatcacttgaactcaggaggcggaagttgccgtgagcccggatcgtgccatggcactccagcctgggcaatggagtgagactctgtctcaaaaaaagaaaaggtcaaaagctaagctatatatatgtatatatacacacccatatatagacaaatatatgtgtatttggacatagacatatacgtgtatatatgtgtatacgtatacacatatatacacgtatatatgtctatgtatatttgtctaacttaacatcaaaagtatacactacaattttaaaagattaattacagcacacacgtcaaatagatatgtgttgtgtgttttagacttatccttttatctgtccgataagtgggtattcatccagaagacctaattcacatattaatttctcatcttctcacagataattgttttcaccagagttttaccaagacacttcataattaggagtaaggaataggttttgaacattttagttttgaatcctacgtctgctaattaccagctgtgtgaacttaggataattatctaatggctttaaatcttaatttcttcatctgtaaaaggattaaataatagctttctaataatactaaatgaccctttttgtgagtgctagaagacatcatacatggtaaacacctaaagagtgctcgccacataaggctcattcaatattaattctgttttcgtggatgatggttattatcaccgttgactcaagagtttggcatttttgttttaatcatttgcttcatggctttacttcctttacagatagcaataattggctatgcatcgatctttcctcagaagctagcacatgtcagaaacatagtagatatttaattaatttagggtgaataaatgaagtatgccacttctttacaaaatgccaccagtgggacttgccagatacacatatgatcttattttacttcaatttcatcatcacctgttctaaagcatctgatctcccgcacatgaaaattaagctttttggaaaatcacaccattgcggttggtactgattgctttgcccaaattattttgtcttccaaaatacactgctgattcacatcttttttttcttttgctcatgtagttattgattacttctgtctagaattgcccttgcctgacttacttgtctgattcacttactttttcaaaactcaactccagtattgccttatctcagaccccagtctaggcttagatgctcccacgtcatgctctgcttcacctacttgtcatatgttatgtgacctttcctgtcattaactgattttgtctcttactcatgagattgtattcttttcaaggatgagcatggtttcagtgtctcaattatgaatgttttgccagagagttcttagttccttactaggattcagtaaacatgtgttaagctgaactgaatattgtatatagactgtacattctcaatacagtttcttgacttatattcaaaaggacaatttttatttttgcaatggcctacataaaatgcttctttaatccccttgtaactttgctgtaaaaattgaactcaagagataagtagttttgaggttttgggaaaggaaagaaacaacgatttgattcttcttgaagggtgatctcttgttacatatttttcctatgattttaatgagtgtattgcaaaaaagttctgccggatccttatattttctagaaaatctttatttccttactcctacttctgtgttggtttccttaaaacatgacatttgaataaaatttatgccttaggaaaaatgtatttcttttaagctgtaaggtttccaacatcgtactgacatagattcaaaggagaggttccatgtcaaattttgtacttcaacaagatcctgttccattccagttcattgcatcaggctatagctttcatttaaaattttttctttgagaatgctgtgagtgaaatgtgtggctctctttccataccaggaaaatcctctatagagtagtgtatactggaaagacttataataagatatactactgatttcccatgtctaacatttggttctctgatgtttatgggctctactaatcagccttgtggtaattggttttctgaccataatttgaacagaaaatattactgaattaattgtttttaattgaaggaaagtcaatgtagtttttataatacatttttactaagagggaccaatatcatatgttcccattggaattagactcaattaacctattagtgttagatgcataaatacccatcctcatacccatcacactgagtacttattacaccctacaacttttgtttagagatagcatgcattatcttatttatcaaagtatctgaagtaactatggttatccttattttataaataataaacagaggcacagaaagttcagagttacatttgaatgaaataacatgttaaaaaagtgaaaataggttttaatttttcatcccaagatggtaaacacatgctcataacataggtctgcattgacctctctatacctggaggctgaggttgagcaatttatatttctagaccaaaattctcgaaaatgaacaaaattatattgcatttatttccctgctattcattacataataggaacacacttaatttttgtacatgaatcatgagcatggttcaagatttccagctctgactctaaatacttttccataatcatcctacttctgttccgtaagtgtatacacacacacaaacacacatatacaaatacatatgtatacacctccactcttactactgttctttctttgtccgtggtgctgaaagcaggaagctgttccataaagaataatgacagaaattataacaataaaaggtgctgtacttatcaaccatcaaaatgatgttaatcatatattgtgcataacatagagatatttgtatttcttggtatattaccctaaattctcaatataaagatcaaaagaacttaataattaggagaataaaataatgttaaatattgttagtcacactttgagaaaccaaaggttaaaagactagccaacatctcacagagagctttgaattgattgcagctgactgcaaatatgctgactaattatcatgccctttaatagtactatcttgcctggcttttatgttagcctagggaaaattgtcatggaaaaatgtgaatggctaaatattttattcaaatttatcacctgtcatcaacaactagaaatgtatgagccagttattcacccaactacatgctgtggtaggatgatggcagtgattataacaaaaactactaccatttactgaacacttactgtgatctttataagggtcagctaacttaatctttacttcaacctcataaaaaataaaattcttattttggagttacagaaccttttacatggggagatttagttgcctgttttccttggtattggagcagagttactgttccaaaccagattatctacaccaaagtctatgctcttaatcattattctgtatcacctgcttcattttatacactcattgttggtagctatcaaaattgtaggtattgtattgccatgactgaagtctgtctttatgagtcagtgtgaaacagtgatacaaaaaatagtatatttccaattagttacctcgtgtagatcttccgtgtgaccttacgaaagataccttgagtttaatactatcctaagaaaaataaattcagggtcagcatggtgtctcacacctgtaatcccagtggtttgggaggctgaggtgggaggattacttgaggccaggagtttgagaccagcctgggcaacagagtgagacccccatctctataaaaataaaaatttaaaaaaggaaaataaattcagaaaaaattgtaccacaaagtcatttgtttgcagacaattatgtattgtgtagatataaccagtctttgacagacatgtcacttacactttggaaattattagacttgcctaaacttgtagttcatttagttgatattgctgaaaacaaaacaaatcactactgtgcctttgatgattcttgagaagttcaaaagggaaatacaacaataatttgctactgctgtgccatgcactgcactacatagctcacagaatttacttttaattatcatataccttttgctctctatttcatatgtatacatatatattcatatatcatatttatttttatattcatatataatatttatatgtaactaaaatattatataatcagtggcgaagccaaaatggtaatcagtgtattttgattataaaacattaaaaatattaactatatcagaagttacaaagtgttcaattcagtacaaatgcaatatttgttgcatttatatttccactttttttttgcccagagtgtgtgttttgtagatgttgcagttgttagagtttgtccatagtatttttgaattaaagtacgtcacaaagaaattaagatttttttctcttgaaatattagccatctggctgtgttaggctcatattcatgcatagatgtattgactaaatctaggtgtactttaaatgagaatgttctctttagggtagtgtagtccccacctggctcacttcactcatttgtgttagcatatgttccctgtaggaattcaggtttgttgcttttgcgttatactcaaatgcactaaagcagggttcggcaaaccatggctcatgcggaacagcctatttttgaatataagttaaggatggtttctgcaccattacaaggtaagagaaaagagagttaataataaaaggggatgtgacagtaactatacatggtccgcaaagcctaaaatatttactatctggccctatatagatggctgacctcttctttagagtattttatgggacttgtttattctacactgcctctgactctttgaaaaagattggtagcattattcaatacaatcatggacactagaagagattttttcatggcaattagcctggccatcttgggcaaaattagagcctttgaggctttcatgtttgtttctgtttttttttttttttttttttttttctatgagctaagagaaaaccatggtctataagatatttctggaagcaaaactaataaccccacatggacagctgatttctgtgttacttctgcttttaaagccagattgggcatcaaaggattgcctgaactgttcatttggagctatttgtttgaagctgattagtgaaaatgctaagtgtgagtaagcaatgttacttaaactctaggatttggagagttttttcaccagaggaatctgatttagctgattggaagggtacactgatagatttcttgttagtaggaatttaggaacacaggggagagcaggtttagcaacacaggcatgctgattatgaagcgtggtaccacttacgggggaagaactctaatatctttagagtaaatgagtaaagagggcctggagatgaatttgataatgtatacctcacccaaaggtactaaaatagggagaaacatagcaagtagcattgtgctcacccaaccagaggcatctctagctcaatcagttcagccatgacttctcattggtaatttgatttgaatcataattgatatgatttggccatgtccccacccacatttcatcttgaattctcacatgttgggaggtaattgaatcatggggcaggtcttctcatgctgctttcctgataatacataagtctcatgagatccattggttttaaaaagaggagtttccctgcacaagccctcttctcttgtctgctgccatgtgagacatgaccttcaccttctaccatgattgtgaggcttccccagccacatgaaagtgtaagtccaacaaacctctttcttttgcaaattgcccagtctgggatatatccttatcagcagcatgaaaatggacaaatacagtaatctttgactattagagtagaagacattcaaaagcattttagtgcatcttcatctcatgaacagcattaaaaaaaagcaaataaaatggtcataaaatttaattaatttgcccaaatttgtcctaaagagtcagcattagtatctagatatcctattgcaaatttggggctctttttattacattgtctataattccactgacttttttttctaaagagcattattaaaaaaatcagttgccgattgcttttgagtagcataccgaaagaacaaaggtcttaggattggataatcaatgtaatgaatatttataagactatttgtaaatggattttgactaatacaaatagatctggtagcaatattgtttcataacatatatctgtgaatggtgttttagtatcttaggggttggggcttccttgctgaggactcagctaagtaagaaagccagtgcattatttttggactcagaatagaccaatgtgaaggtattaacaagagtaaagacggcaataagagggttgagctattttagcttttccctcaagtaagttttaacttttgcttaaaaacattaattttaaggatgtctattttgtttttgaggccactgtgccaccaggttatttattaaaacaattaatgattaatttactatttttctgccaatgaaagagctaggattcataggtttaattatggctgtgtcagttgctctttatggaggctttggcaagtaatttaaattctgaatctaacaaatttcctaagaatggattaactagtagttctaggtacatactgtaaagtatatataggaaactaaaatttagataagacatatttggtttggcgagctgtaaggagttaatagttttaataaactgtgttcaggataatgtgagtgtaagatatgttcagctgaaagtaaagaaaatgattaaacaaaaatatgaaataaacaacaacaaaaaggaacgagtaaacgaaaatgcagtccagcagcaacaatatgctagaaagttggaggaaaccctgaaaaatggaaagctgttgggaccagactaatgggaaaaagtactgaaggggaaagttggaatcttttcgaagaaaatgattaatagcatgcacaaagatgtcctggaatgtttatcacatcagtacgagtcatagaatttggaagcaaactttcctttcaccaacacgtcttgttttaataaatcatgatatatcaatactttggaacattatgtagccattaaaatgatgttactcaattatatctattcatatcaaagctgcaaaatcacacttaaattattcaataaaaatttatttagccccttctaggcattggacactattatgtgtactagaggttcaatgataaactcaaagtagtcctgctttgagtttattgtctattaaatagaaaacagtcatcaggtacatatgcagattagtgagtgtaaagttacaactgtgaaaacattcttaaaagcctcatcttaaggaagtgtgcaaagtggggtctggatctaattggggatttgaatgggctttcctgaaatctgaaggatgaaagaattgagttaactatgtgaaagttagggggtaaaaatttaagggaggggagaaaaaaggtcatatgaccatatggatttttgctccttagaaattgaaataagatttctgtggctggaggttagaaagtaatctgtgaatgtaggataaagttgaatcagaaaaaggaatattaaaaatttgctaggtgagtttctctaagtttcctcatataagcgagatattattcacagaagcagtgagtagaatggtggatacctggagctggagggaaggtggggaggttggggagatgatcgtcaaaggacataaaatttcagttagaggaataaagtcaagagattaattgtacaacatggtgattgtagttaataacaatgtattatatatttgaaaatcactaacagtaatttttaagtgttctcatcacatacacacaataatcatgtgagataatataattgtaatttgttaaatttagcgttatacaaggtatatttattttttaaaatcatgttatataccataaatatatccaattcttgtctttttaaaaaataaaattgctgggtgacaaatattgaatgcttaccgcatgttgaacattaagaatgatcacactaagaactctcaatagcttttgagacaggtatgagtatcatttgcatttctccagataagtacactaggatgaaactaaacccatgtcacacagtactgccagagctagggtttgaatccagactgaatagcaatcactgtgctacactcatcttttgggtaggagatagtccataggtctattttaaatgttctggattttgatttttatcctaaaataagataacaagcattggcaagttgccatttttttgataaattcttaaggcatttgtggggaggaatattcaagtggagagaaagagaaagtaaaggaggccagcgagaaagctattaaataatgcagaggagaggtcatgatagctcgctccaagagggaagattagagatggagggaagaagacaggttgcagagacgcagaacaggtgaaattgcatggtactccataatggacctgctggggtgcaacgtgagaggccgatctcaggtctgtgtggaggatgacaacctgccttgagataggcagcactgaacaaagggcccgatgactatgagtgtgttctttttttttcttattgagtgcttcgaaacacttatatattgaagtcaaaccgcatgaatgtgtgtgtgtgtgtgtgcgtgtgtgtgtgtgtgtgtatgcatgtatatctggaactcagggaagtttactgagctggggatagatttgccaatcatctatgggtagttaggaattagaactatgggtatcaatgaagtttcctagggacatacatgaatgaatagagatgaacataataaatcaagtattaatagtaattatttctctgttataattataggtattctttgtgctagttttctttatttgtatttttgttttactttaatcagcatatattgatttttgtgggaaaaaaattgaaaaagattttttttttcaattgagaagaaaaagtttattgtatatggcaaagggtagaggagaagagaaccaagatggacccggggttttgtgtctggatcaaaaggcttttctcctctcattttgcactgtttaccccactcagtttggcgctaccttttattactcactagcagtatcatttccatcaaaactctaatttttaaatattttttggacagtaatgttagctgttatcagaagttgtcaacagaacttaaattcaattttacttatactttaacatacaggctgcacatgctaaatgcttgtcacttagaatgctgttctcattagtctggattgcagattttgttgtcatgatgatatgtctggcaacattctcatagtgggtgagctcgactgtctagggattatcttctattacagttcagtttatcatgctctgtttgatatgttctttattaagaaacttaattacctatagttctagatattatgtgctaatgagttgtacgtgtgagtaaatgtattccgaactcatttttggctgctgatatatttctacaaagatgctttgagaaaaagaagcgataagatctgcttccattcttggtcagaaaagttgccacttagtcataatgtggctttattccatgtttccatgaaattcatttgagacatagtaaactcatatttttgaatttaatatttgtaagcacactgtcagttatccacatagtcaagtaaaacttagccgtgaacaaaatctttgaactgtaatgtcatattgtgtcaggtaatcttattcagctatgaaatacttaatactttaaaaatgacactttattgagcacttctatgtataacagtgtttagtaaaatgtttattttgactacttactatagttacatcaatttggtatttccagcagtagtcagaggaagcacaatttaattaaatatgtggatggagaaaattgatttcagagcaaagtttcttgtttcagattacttgtttggatctcagattttgcgtgttgttaagggacttacatttgtataaccaattgtaataaatgaagatttccatgaggcatatggttgcattcatttcggaagaactacagatttcaagtaaaacaaaacaaaacacagaaatcactgaaccaaggcacatttattgagtacagacatcaaacaaatctcatttttgtattaaaatctaaaaattccatataaatagctatgtttgtaggttgttctcttaggctaaaaataaagacagatattgcatctttcatcaacctaacatcaagatatttgcgtgggaccaatcttctcaagatttgattttaaattgttgcttagtcttattcaaattgcatgtatccttccctctcaaggtacataaaatgaaatgttctgaaaagacaattatgtgaatatgggagattctagggacttacagactctactaattttagcaataatttttttctcatagtgaggtccattttcagagtacattaaatcatgtatgaatagtcttcatctttcagtaaagaaactgattcttccagttgaaatttaaactttcttttactctctttttcttttttctgttgtcaacttcattgaaatgtaatttgcatacagtgaagttcatccttcttagtgaacagttctgagttttggcagctatatatatctgctgccactattaggatacagaatagttagcccaaactccctcttgccccactttagtcacctttccttgactctcactctttggtaggcgccaatatgttttttgttcagatagttttgctttagcagattgttatataaataaaatcagacaatatgtagcctttcaggattggtttccaaagttcatctaatgcatttgagattcgtgcatgctgtggtgtgtgtatcagtctctgttttcttttaatgcagaatagtatcccattatatggatatgccatagtttgttcagccattttatgctttctttttattctcttttttcaaaattaattatttatttatattaattttgtgggtacataatagttgtatatatttatgagatacatccgatttcttttttttccttttttttttttttggagacagggtggtagtctgtcacccaggctagagtgcagtagtgtgatcgtggctctctgcagcctggaccaccctggactcaaccaattctcctgctacggcctcctgagtggttgggactacaggtgtgcactattatgccttgctgatttttttgtgtatttatacatatattttttgttgttgttgttgacatggggttttgcaaaattgacagactggtgttaaactactgggctcaagtggtctgtgtgtcttggcctaccaaagtactgggactacaggtgtgagccactgcacccggccctatacatggggtacaggagatgcttgatacaggaatacaatgcataccagtcatatcagggtaaatggggtgtccagcaccttaagcatttaccctttctttgtgttacagactataaaattatactcttttagttattttaaaatatagaatagattattgttactgtagttaccctgttttgctatcaaatatagatcttattcaccctatctaactatatttttgtacccactaacaaaacccgcttcaatcccccctccagccactaccacactaccattcccagcctctggtaaccatcattctactctctatctctgtaagctcaatttttttttaaaaaatttagtttccacaaataagtaagaacatgtgaagtttgtctttctgcaccacacttattccacttaacataatgacctcctgttccatccatgttgttgcaaatgacaggatctcatacttttatatggctggatagtattccattgtgtataagtacaacaatttcttcatccactcatctgttgatggacacttaggttgcttccaaattttggctattttgaatagggctgcaataaacatagaagtgcaggtatccctgtgatacactgatttcctttcttttgggtgtatacttggtggtggggttgctggatcttataatagctctatttttagtcttttaaggaacctccaactgtttgccatagtgcttgtactaatttacattcccaccaacagtgtacaagggtccccttttctaaatatccttgccagcacttattactgcctgtcttttgaataaaagccattttaactgggatgtgatgatatctcattgtagctttgatttgcatatctctgatgatcagtgatgttgagcatctattcatacacctgtttgccatttgtagtcttcttttaagaggtgtctattagatcttcgcccatttttaattgcattattagactttttccctatatagttgtttgagctccttatgtaatctggttattaatctcttatcagatggatagtctgaaaatctgttcccccattctgtaggttgtctcttcactttgttgattgtttcctttgctgtgcagaagctttttaacttgatatgattccatttgtccatctttgctttcgttgcgcatgcttgttgattattactcaagaaatctttgccaactacaatgtcctgattcctcagtggtttttgtttcttgtttttgtacagtagtttcatagtttgaggtcttagattttagtcttttatccatgtttatttgatttttatatacagatctagtcttattctgcatgtggatatccagtttctccatcatcatttattgaagagattgttcttaggacctttgtcgaaaatgaattcactgtatatgtataaatttgtttctgagttctcctattctattctattctattctattctattctattctattctattctattctattctattctattggtctatgtttctttttatgccagtagcatgttgtttgttcactatagctctgaagtataatttgaagtctggtaatgtaatttctccattttttcttttcttttctttcttttttttttttggcttaggatagctttggctattctgggtcttttgtgattccacgtaaattttaggattgtatttcctatttctgtgaagaatggcattcgtattttgataggaattgcactgaatctccagattcctttgagtagtgtggacattttaacaatattgattcttcgagcccatgaacacggaatatctttgtatttttcttgggtctccttcagtttcttttatcaatgttttacagtttttattgtagaaattgtttgttctttttgttgttgttgttacttcctagctattttattttatttccggctattgtaaatgggattactttcttgatttctttttcagattgtttattctgggcatatagaaatggctattttaatgttgattttatgtcttgcagctttactgaatttgtttattagtttgaatagtccttggtggagtctttaggtttttccaaatataagattatatcatctgcaaagatgatttgacttttttctttccaagttgaatgcccttcagttctttctcttgtctgattgatttagctaggacttcctactttattttcattttgtaggtagtatttctgccatgaacactaggattatattaacattttaactagttgctgttgtatctacttttattttattttagaacttttccaatgagttgttatgattgtagactttctaattgaagagctttttatttattaaattatttgtaaacatttcaattgtaataagtattgcatttaatgaaaaatgaattgctttagaaaatattctattaaaattctagagatatgttaatgatttatttgttgtattttttggtatgctttttccggtaaaaaaattaattatgaaaaattggaaacaacagacacgtataaggaagaaaaatccatagtattctaacatggctcatagtttgctggaaagtaattacaaattttttcagtctctaatatctgcaatatcaatctcaaagattgagaacttctggcacaccatagttggaaattttaaaagtaaagccaaaattagctaatttagttaagtgagttaggggaagcaaggtgaacctatggagtacagataagaaaacacacttcagtgttcaagacatcaaaaagaaaaaaaagaggaaagaaaaatatatttcattatttgaactagattacattcttccctggagttccctacttttgttatcctgcataactgtgttttaagtagggttaaaactaagatatttcaaattctgtagtagaaaaaaaatagtctggtattatagattaaaaaaatgaattaaatataattattaatctaagttatgaagcctaaaaaattctaactcatttgtttaaaacacgaatgtccatattcttttactttattccatgatatatgaaagtataatagcatgcattctatttataaacatctatgtttatcttaaggtacatatgctaatgaacatttacaaattgcatcccttacattttgctatgaagaatttaaagcacatactttacagtttgattcatattaatacttaaggtctttttcatacaagttgtacctacattaaaaattagaaggggtcttagaagtcatcttagtccaagtaccttatttttctggagaagaaattcatctcttaaatggttagtgaatagaaaagtttaaatagatacaaggatccctagtttcaatacaaaataatttcgcctataacatcactgggatgcaatgaatctcaccaaaaataattttctatatgtctgtttgtaacaagcgttagcccccaagtattttaatcaagaagtagcgatatatgaaagaaatccagtcttgtggttcactcttttctgtgactctcaccatttccctccctctatgctcccaccacagtatttgggatcagctccaccttatctcttgtcaggccagtacttctcacaccttagaggatatgagagtcatctggagaatcagtaatgagcacaaattagaatagggcctgggcctgtggatttgcaccaacttttgtgggtgagttttatgccccctaaagaaatcactggtgtagactcctgcatgtgcttccacataagccccttcctctccagcctttctcattcgtctcgaatcaagaggacgtactttggctggcacaagccttctaactgcctagtccattgtattgttccaaacaagttaatggcatgcactgaactgagacacactttccaccttggcatcggaaggctcccctgtaacattctagcctgggtctctactccagcatgactgaactccggccctttaagaggaagcattaaaagtgtgatttctgttctcagaaacttgagttaagcttatagttactactaagagaaatgttctgagcttcaccatttttctggaaaaaaaaaaaggtttttaggtgctttgaatatgatacataaaagctgggtatgggggagaaggcacttagcaaacttggggatgataatatgataggctggtcacctttctgtttaattattttgcttacaatgtttcactgaccataggttttgaacttatacatgcttcaatcttcagttttgatttcactacttccttgtgccttctgatttcccttgctgtgtgctttcttactcttctgaacatgtatagagttgtcatatagccactggaaaaaaaattctgccatatatgagtgctcgtatgcattctgcattatcctcacacaaggcaagggagctgatttcatttccttttgtaatcactgcacatgacaagttcccaaaatacatattgaatgaagtcaatgaatacacttattttgaactcttaatctttataaacattaatattttctggtaatcataataacagctgctgtttattcagtagttaacatgtgccagccttggtgctaagtgttctgtgtatgttattattatgttcttagaacaactaccccgagatgcaagtattttaattccatttcatgtatggggcagtttgaagctcagtaaaaaaataccttaatcacttgcaatagctaataaggactagagttgagaactaaatataaactcctagcaactttatcgatagtgtctatcgtcatcttaatcttgactgtagattgactgtttttgaatggacttaaagtgacagcaaattagtgaccaccatgtcatattttaaaggcttacaatgaagtaatttattctgttatataaaatagaatgatctttcatctaaattagagaagttttgcaattgtgtaggtatattgagtgtgtgtgtgtgtgtgtgtgtgtgtgtttattacatgcagttcaagggaggctaggtatatgataatatcttatccaagaactgttcccactgtgcttcccgaaagaaaaccgtctgatttcatgtcatttcaggcactttgggttattttaaaagtcttatctagttttttaagacatggttctagaatgcagtctaagaatgcagtcccgtgtgtgattataagacctctttctcccttccagtctttccctggttcagaaaagacttgactccataggcatcatttggagctggagaagacctgttcttttcccatcgccttcatgtgctccttgctttccccctggtggttctactttatagaggacattcaaatgggagttcactctgggatccattggatagtttttcttagggactctgggtctcccctagagtttcctggaatgagcacttagtctctgcaaagaaaaattgacagcagagtctgccacaataaaaatttctactcaagtttgtagccctcttgtgggcgtggacaggatgatactccatagaatttccacagcatccttttcactcatggaaaactcactcacctttgccacaccaaatgtgggatgcaggcttttccccatcttccacacacataccccatttctgctcacctgtctctcccttagcccttcttctgcccagtagtatcaggtggatttaaagcttagaaagttctagaactaagagataaatcagccttcaaaacagtaggaagttaaatggaggtagtgggggaaatgcttttcaaggtacctttatcttgaagaaagggacattttaataagcaatagaataatgatgaagaagtggttgtattccctcaaattcacttattcccaagttttatagatctgtgtttattatattttttctgcagcccacacttagaaataatttttgcattacaatcaagttggctctctctccctctctctccttttctcacacatcacatacctgaaataataatagtaaactcagcattcacctattttatataccctgcactatgtttccttttcttcttctatccagtactatcagtgtttaacttgcttgtttcgtgacccacaaaactgattagataaccttaacctttgcatgcgtcacgtttcacaatttataaagcactgctgtagaaggtaaagactaataaacgtgttggttgacctttcttcccttgtacaaaggattctcaggtcaatagctagattttactaaactggccctgaaaattttataattttgattctcaatagcagttttctgtactctagtctgtgagttactggggaacatttgaaggcaagaagaatagcagttaatacggcgtgccaccttctcaccatgcacactggattcgcaggtagctgtgtatgcatgcacttacatttcctaaaccagttttattgtttttcctgaacatacatgcttgttgtttaaaaaaaactgttctgaaatatataattctttctcattcctgcagagtaatcactaattcaggtcttttttaagtcctacttaatacatataagcacccacgcatgcttatactttagtagtctttttgtttctatcacggtcttgtttattctaaaagttgatcattggagagaaggtgaccttgacatgaaagtcggctcttgcttcaaagtctaaactgggacctccttgctgccttgaagggtaaatttatgatctctctgggataagaacatgatctttagactctattaacttttatccaacttctttctcatttaacatgaaaatgcttaggtttttgtttttaaccttgttttttagctttcattgtgcacttgctgatttcgttctcagtgtgacctcttaaatatccaaagggaaaggaaaattgctttagaaaacctctgtgcaaggaagttcagagaattggacttacctttgtaagaataatatgagctggatatagtttactgggacacaaaaatctgcatataccaagggagtgggacaatagacgtaatgatgtgaatggtaaaaataataaagaggactttgcctcatttattgattttttcaagtattttccatctgagttactgagtacagatctcttcctttcaatttacaaaaactaaaagaactaaagataggcaattatttgtggtacagatgcatttacaacaatataattctgttttaaaatcaagttgccttactcatttcaaagctaaggttgtgatggcatttctggaaattctccaatttatcttaaagttgacagtttttttttgtttgtttttttggtgggggtggtgggtgtggagaccgagtctcactctgttgaccaggctggagtgcagtggtgcaatcccagctcactgcaacctccacctccctgattcaagcgattgtcctgcctctgcctcctgaatagttggggttacaggtgcatgccaacacacccagctaattttgtatatttagcagagatgggatttcaccatgttagccaggctgatctcgaactcctggcctctggtgatccacccaccttggcctccgaaagtgctgggaatacagacatgagccactgcgcagccaagctgacgtttcttacagctattgcctcaaataagtacacgatggaggatgtccttatggcttaagtctgcctcatagacgattgttcagtgaaacacttaaattactccctaagtctcaactctaattccttaggtcataactaaaaaatttacttttggctaaggagtgcaagaaacagacaagcaaccaaaacaaaacctatacatactccccctccaaacacacaccaagattctctttaatattcattatgataattgtaaccatataaggagttctttttgcgtgtctgacagtatgctatacattgtcactaaacccccaaagaaaacttagaggtattattactaagttacagataaaatttttttaaaaagatttaagttgttctaacgtcacgttggtgaagattttaacccatctttcagaatataccatggacatagttgtcaggcaagcaagttagtgtagagatgcctttcattgtttaatggtaggtgctcttttagatgtctggtaggaacccaatagttatcttgtttattaataataacaggatcaagaggggaagtcattttctttggttctcttatttccaagcaacatttctgcattagtaatgaactccttaaacaaacactgaggattcttattagctttctttttctatggcaaacattattaactgatcacggcatctttacactggaagggctgggcagcagaagcttccacagaaggctctctggccagacaccaccaatcaattattgaaggtatcaaaattaaaaccaatgtgccatttctgcctttttctatcctatgactctcttacactgaggattagaaagacaattttgaatttttcacttaagtcttaagagacatgttgatttgcaagaggtatttatgaggtgttatgcagagtaagctagttaactctgatatcctctctcatggagactaagtaagttggctttccctgttaaggaaaatagtgttaacatctgcatttcacagtgagttaagaattttcgggaatggggcattacatttacggcctaggttctgaaattgtacatgaacaatttgagctcaaagattacaatgttgaaaatcagtgattttctaacagctccttaatgtatagcagcagcaacagccatcacaataataatataacttttccaggttcctactatgaagctaagctctatacagacaaagcttattttattgtactttgtgttattgtgctttgcagacaatgcattttttttttccaaatgaaaaatttttggcatcatttttgcagcagtatatgcctaattcatgtgtttgggtcacattttgggaaatctcagaatatttcaaattaattcattattattgtatctgttattgtgatctgtgatcagtgatctttgatgttactctcataattcttttggagtgccatgaaccatgtcagtataaaacagcaaagttaatcaataaatgttgtgtgtgttctggctgctccaccgactagctgttgccccatctatctccttttccgcaggcctccatactccctgatacacagcaactttgaaattatggcaattaataatcctatagtcacctctaagtactcaagttaaaggaagagtcacacatctctcaatataaatcaaaagcaagaaaagattaagcttaatgaggaaggcatgtcaatagccaagacaggccaaaagctaggcctcttggttcagttatccaagttgtgaatgcaaaggaaaacttcttgaaagaaattaaaagtgctactccagtgaatgcacaaatgataaagcaaaacagccttattgctgatatgaagaaagttttaatggtctgtatagatcagagcagccacaacattcccttgagccaaagcctaattccagagcaaggccgtaactcccttcagttctataaaggctgagagagatgaggaaattgcaaaggaaaactttgaagttagcagagtttggttcatgaggtttaaggaaagacactgtctccataacatcaaagtgcaagctgaagcagcaagtgctgttatagaaatcacagcaaaccggttatccagaagatgtatctgagatcattgctgaagttggccacactagacaacaaattttcagtgtagccaaaacagccttctattggaagaagatggcgtctaggaattttagagccagagagaagctgatgcctctcttcaaagcttcaaaggacaggctgactcttttgttagaggctgatggagctgacagctttaaaatgaagccagtgctcatgtatctttctgaaaaccctaaggaccttaagagttaggctgactgtgctctacaaatggaacaacaaaccctggatgatagtacctctgcttgcagcacagtttactcaatatttttaagcccacgattgaaacctactgcttaaagaaacaacattttctgtcaaaatatacctgctcattaacaatgcacctggttacccaagagctctgatggagaggtgcaaggagaataatgttttcaggcctgccagcacaacattcattgtacagcccttgagttaaggataattttgtatttcaaatcttattttttcaaaagttgattccaaccctcatgaatgactttgagtggctcgagactttagtgaaggaattagctgcagaggtggtggaaataaaaagataactaaaattagaagtggagtctccagaagttcctgaattgctgtactctcatgataaaacctaagtggataaggatttacttcttatggatgagcaaagatggaatttactcccagtaaatacgatgtgaacattgttgaaatgacagcaaaggatttagaatattatataaagttggttgataaagcagtggtagattgtattagtcagtctagagggacagaactaataggagatatatatgtatatataaaagggagtttattaggtagcattaactcacacgatcacaaggtcccatcataggccatctgcaagctgaggagcaaggaagccagtccaagtcccaaagctgaagaacttggagtccgattttcaagggaaggaagcatccaacacaggagaaagatgtaggctgggaggctaagccaatctagcctttttatgtttttctgcctgctttatgttctggcagcactggcagctgattagatggtgccccccccagattaagggtgggtctacctttcccagcccactgactcaactgttaatctcctttgacaacaccctcacagacatatccaggatcaatagcttgcatccttcaatcaaattaagtcgacactcaatattaaccatcccatggaatttgaaagggtagactctaatcttgaaagaagttcaactgtgggaaaaatgctatcaaacagcatcacatgccacagataaatactttgcaaaggaaaagtcaatcaatgtggcaaaatccatcgtcttaatttttgaaattttcatagccaccccaacattcagcaaccaacaccctgatcagtcagcagctagtaatagcaaggcaagttcctccaccagcaaaacatttagactcactaaaggctcagatgattgttagcattttttggcaataaagtgttttctaattaggatatgtccactttttttagatgtaatgctgttgcacactagtagaccacagtataatataaacataacttttttttattatactttaagttctgggatacatgtgcagaacgtgcaggtttgttgcataggtatacacatgccatggtggtttgccacacccatcaacccatcatatacattaggtatttctcctaatgctatccctctcctagccccccaccctccgacaggccccagtatgtgatgttcccctccttgtgtccatgcgttctcattgttcaactcccactaatgagtgagaacatgcagtgtttgattttctgttcccgtgttagtttgctgagaatcatggtttccagcttcatctgtgtccctgcaaaggacatgaactcatccttttttatggttgcatagtattccatggtgaatatgtgccacagtttctttatccagtctatcattgatggacattagagttggttccaagtctttgctgttgtgaatagagctgcaataaacatacgtgtgcatgtgtctttatagtaggatgatttataatcctttggatatacacccagtaatgggattgctgagtcaaatgatatttctggttgtagatccttgaggaatcaccacagtgtcttccacagttgttgaactaatttgcactcccaccaacagtgtaaaagtgttcctgtttctccacatcctctccagcatctgttatttcctgactttttaatgatcaccattctaactggtatgagatggtatctcattgtggttttgatttgcatttctctaacgaccagtgatgatgagctttttttcatatgtttgttgaccgcataaatgtcttcttttgagaagtatctgttcatatcctttgaccactttttgatggggttgtttgtttttttcttgtaaatttgtttaagttctttgtagattctggatattagcctttagtctgatgattctggatattagctctttgtctgatggagagattgcaaaaattttttccaattctgtaggttatctgttcactctgctcatagtttcttttgctgtgcagaagctctttagcgtcagcatgacttttaaacgcactaagaaaccaaaaatgtatgtgacttgcatcatcacgatatttgctttattggggtgatatggagtcgaacccacaatgtcttcaaagtatgcccatactaagtacccactccttatacactcaattttcacaacaatcttgtaagataattttattctttataagtcaaaacaaaatatttacagttcaggcttcagtaacttgcttatcagcaacacagctacacttctcaactgaataccaaggctgccttttcctctaaagttgtaatgtgacatagtactaaatgataccagagacttttcatggcaaacctataaaaaaagtagtgttggtcgggcgcagtggctcacgcctgtaatcccagcactttgggagtccaaggcaggcagatcacgaggtcaggagttcgagaccagtctgaccaacatggtaaaaccccgccactactaaaaatacaaaaattagctgggcgtggtggcaggcacctgtaattccagctactcaggaggctgagacaggagaattgcttgaacccgggaggcggaggttccagtgagctgagatcgtgctactgcattccagcctgggcgacagagcgagactctatctcaaaataaataaataaataaataagtagtgtttctaatatctctcaggctgtctttaaaactgcatgtttaaacagtttgctagactaatatgttcagtatccttggtagttgtaagtttcttgtatcttctttctttactctttctctgcaaaagcataatccatctcattgctgatattctcagattctaatctggtacaggttaacaatataaagcagtatgcacttattcacaaaataatatatatttgtagattttgtgattcacaataaatcagtaatagcatattgctctctctctcccctactggccttggtgatagttgttctgggaattctataaaccatggcatcatcatgagagagacacacaggctttctttctgatgttaatcaaaccatttctatttcttcatagcttttcattagatggattttggctttatgtaatacagaaacacatcttacttttaaattgaactgtatgattttaatttattcttcatctttgctaattgttttactttggtcaaatctgaaaatccttctatacctcagaaatgtatctggaaaaatggggataaacataaatcacagggttatcataaagattttaatatactagtgaggaattcctttgaaattgagtatgcattgactgctattgttattactagaacgacttggaagtggacatgaatcatttttaaatagttgtttggtggtacagtttttttaaaaaaaatttctataggtttttgggggcaggtagtatttggttgcatgagtaagttctttagtggtgatttgtgagattttggtgcacccatgacccaagcagtatacactgtacccaatttgtagcgttttatccctcatgctcttcccaccctttccccctgagtcctcaaagtccattgtatcattcttatgtctttgcatcctcatagttgagttctcgcttatgagtgagaacatacaatgtttggtttctcatccctgaattacttcacttggagtgataatctccaatcccatccaggttgctgtgaatgccattaattcacatttttttttcttttatggctgagtagtatcccatcatgtatatatcccacagtttttttatccactcatcgattgatgggcatttgggctcgttccatatttctgcaattgcaaattgtgctgctataagcatgcgtgtgcaagtatcttttttgtataatggcttcttttcctctgggtagatacccaacagtgtgattgctggatcaaatggtaattctacttttagttctttaagggctctccacactgttttccatagtggttgtgctagtttacattactaccagcagtgtagaggtgttcccatttcaccacatccatgccaacatctatttttttttttttttttggttatggccattattgccagagtaaggtggtattgcatttttggttttgattggcgtttccctggtcattagtgagattgagcattttttcacatttgaaaacatagcttagctcccacttataactgggggccatttctatattttcttttaatttttaaatagtttaaaaacataagcaaagctatatagtctcatattttaacaactagcttgaaagtatttaatggaaaaatttatattagtattgcttatgtaaacctttattggtagttggtgatacttctatcactcatgttaaattctcttctcaaataaattatagtgttttataacacacacatacacacacgtgtgcacctaacatttgttgtgatttgctaagtactaggcatataatttgcctcccaatttattacaagtaaggtttatcaaatattttaccactgcataacatggaatatcaccttgccagcctccaatagtatttccttgacaccagctgcctgactgctaaggcgttgacaactatttttgttttaattgtagcaggatcccactcttggtacttgtttaggtattagggtgatttcgatgggcccattaaccctactgactgagcatctcagtggctcaacacagaaaagatgcatttcttgcccatgctatatgtctgaatgactgttgattggctgcaagtcaacagttctaaaataaaactatgcttagctttaaaaaaataaaataagggtcagtaaaatatctagttatttttctttatttttattttctcacattttcatttaattttacattattttataaatataactgtacaaactgtaaagccagttatttgctaaagagttttttgataaaacaaaatgattgagtagaaaatctcaccatgatctttgacttacttaatggtagttacagaaaacaatttatataaattaaaaggccatacatagtccaagcaaccaacaagtatttgactcatacaaatctgtatcatgatgtccattagctcaagatgttgacttttcttctttttcttcttgctggtttttttttaaactattttttttttcatctagccaccagagaatgcttatgggaagttaacataaatatcaaacagtgttttcaaatattgtttatgcttgactgaatagggatttgcacaaagagtggttaaatatatggactaaaatagatgctccccattataaaataatatttggtagattacttataaaatttttcttgttattttgaaacccaaagttgtttatatatatagtcctactttttagatttaagccttttttatgtgtttgctattaactgacttagaaaaagtaataccttaaaataagaaaataaatgcttaggacaataggtagattgaaaattcatttgaaattaaaaaaaatctgtgacatttatttttgtgcatattagttccagaactgaaaataaagccctggcagtctcagtgtctatatatatatatgtgtgtgtatatatatatatatatatatatagagagagagagagagagagagagagagagagagagagagagacatatatatgaatgatatgaatgtgtactatgatacattggcctttttgaattacttttacaattgctatagttaagccataatcatagcaaaatatttcaccaagatgaaaggaatataaaaatgtttctggcattataaaaattgcagtgaagaaattggaacttaaagccaaaacaaatagcttacataattaaaacagagctttgtctgtggtaaattttttggcctggaaatgtgaaatatttcttaattcttgaaagtaatagttgtgaacacttcataaaattatagtgagagagagaatgtgctgtaattagcagctgaagagataaatagaaaatcttgcttagtcgtgtaccttacattttcatcctgacaatgctgaatacattttaatgagaataaaataaattaaaattaaagcatcagcatagattctatatatactgtttttccaatccacattccaagagtacctctgtgtttaccattgctatatatatatgtgtgtgtgtgtgtatatacatgtgtatatatatatgtatgcacatatatatatacatatatatataatttcattagtttgggggaacaggtgttttctgttacatagataagttctttggttctaatttctgagattttggtgtatctgtcacccaagaagtgttcagtgtacccaatgtatagccttttatccctcagctccctcagccccttccccccgagtctccaaagtccatcgtatcattcttatacctttatgttctcatagcttagctcccactaataactgaggacatgtgatatttgattttccatccctgagttacttcacttaaaataatgatctccaactccatttgggttgctataaacgccattattttgttcgtttttatggctgagtggtattctatggtgtatatattccccatcttctttatctattcattggtgaatgggcatttaggctggttcgtatttctgcaattgcaaaaacaaataacctcatcaaaacatgggcaaaggacatgaatagacaattctcaaaagaagataaacaaatggccaacaaacatatgaaaaaaaatgctcaacatcactaattatcagagaaatgcgaattaaaactaatgagataccaccttactcttgcaaaaatggccacaattaaaaaaatcaaaaaataatagatattggcatggatgtggtgaaaagggaacacttttacactgctagtcaaaatgtaaactagtatagccactgtggaaaacagtatggagcttccctaaaaaaccagaagtagaattaccgtttgatccagtaatcccaatattgggtatctacccagaagaaaagaagtcattataagaaaaaaagacccttgcacatgcatgtttataccattgcttttagattttactttgcagacttgtaagaattctgtgatacaatgggaatatgttacttttgttgctgagttttacatgatagatttctgtcatataagtcagcaataaaattaatgattaatgattcttatgacctccttatatatatcttaatgagaccaacattaaagtttggcattaattaaattctgggccaaaaaatatattatttcagacgcagcttgtacatttttttaaattgacttttgagctgatgttaggtttgattagaaaaacatattcaatgagctccaaaagttgtgcttatatgtgatgtcagaaatatccggatactgaatacagaaattgaaatgaaagatggaaacctgaagaagactacttttgaaatagagtgatctaatttttatatttactaccttcaaagcccacctctcactgtatacttttttggggtaaaaaaaaaatgtgcacttcacattcccagttatctacgaactgactagattcatttaaattcattacatagttatcaaaccttcactacgttacaggactgtgctacatactggctagacgacaataatgaagctcattgaaaatatcattagggacacacataatttgctgagctttccaccaatggaattacctaggtgctctggtacatgaagacaaactttattctgcctggggaaagcactggggttttccagaagaggtcatctttggttaagccttaaaagaattggtggattttttcaagtagaggtctttctgagaacactgtaaactgaatgatcagtgtgaacaaatgtatgggccgtaagtggcctcacagagacaggagaaatgtccactagttgagtgtttattgtagcatctgggcgaagtgtgaagagaaacagatgagcagtgtgtcaagtagggaggagaggcgacagaacggagggaaactggaattgtgaggattcagtgtatgggacacacacagatgttgttggggcggtagacaggacttgggaactagatttgaactcttattttactatatgtatacttattttacccattattatacaatgctacatattctgatagtaaaataagtataaccacatctaccatgttcacatcttgaagagggttgaagaaaatcaaatgacgtggcttcgaagtccttcctccgaaccagataggttctgctcagtgagtgagggtgtatttgcctagacatgcaaatgaatgaatgagagaagtgcacgagaaaacctactatcaccaaagacctacgtcagttttcccaaacagctttattagtaatacagctaacatttaaattcaaaaatgataaaatgaggagaaatgcttacatttgtcatttgtattagggatgagtgactacaattgggaaacagagaggaagacatttttgtatttgaattgttgatagatggtaatgctaagaacaggataaagaatggaggagaaaaatgaggagaagctggggagagacttcaggtaggatctactgtttttttacagttggtgaggtgcctgcatgtcctcatcattgagctacaattttgttttgatgtcaaccaaggtgtaaaaactagatcatccgtatacaggtggcagttacacttgtgggagggaatgtgatgcccaggaatttgtgtaataattcatgtgttagacagttgaatcatgaatagtgaatgcagaaagcaaacatatgatgtaaattcttgaatgatatttatctcggagaatcaggagaccctgaaatgagcaaaaagaggatgactgccccatgaaaggagccctagagggaagagcgaaaagagatagaagaatgtattagggtgtgaacatcacacaactgatggataggataagacctgagaaagggatcattactcttgccccaagagagtcagtggtgtcttgcattgagtacttttcagtggagtggctggagatgaaatacaattgcaggaaattaaagaatgcatggaggtaaaaacaaagaaacagaaatgcagtctacactttcaagaaggttgatgatgatggaaagaaatgtgtttgagaataaaacaccccgtgaaagattagcatgcaaagacaacacaacaaaccaatatactgttttgtttttccctttggtcctattccaactagctaatggtggctgtatagccttcttatatgactcaccatttagtttaggttttctgtctccagggagagcataacatggtaaacccttggaatatcatgtctcctttgctagttttcttctttccagttcaggggattgcagtgatattttccatcattgactgcagcaaagatcccaaaggtggaaatatgcctccctcaaaggtactgatgtcatctccattaggaggaatttctgtataatctcactaaagacaccatgaagatttgtcctgtgttttcagtgtctgatggatgctgctgtaaggcagctcttagtttttatttgcacttttatgctttaatgcaattctccctctctctaggactcaagtatgagtcccacaggagaagggctggcagaggcattaagtgctagaccatgagctgtattgcatcattctttcattcagacctggctcgtggttttaaactatagttgtatactctggcctctttttctttagaagatatttctttcttttttcttttttttaaggggcctctctgactatgcttacagacttctttttctttgtgagtcaatcctgcttgcccatcacaagtactcagattaggctaccaattggagtaacctgctgctacgttagttattacagagggaattgtgttatacagagggaataagttatacagaggtaatgatgaagtaggtaaagttcaaattgctgttctcttgcttttcattgaataagggagggagatggggtaaagggtagcaaactgataatggaaaggaagagtggtgctactttcattaatatctaaaaagcaatagccgacataactgtcttcatgctaaaatcaaaagtgtaagcaatatgataattcttaatactgccatgtgcagatgtaccaatcatgcttgtgttaatgcaccatgtaaccgagaagatgaagaaatcaaagacatgtgattacatccaaagaccaggagaaaatcacgatagtattgaggatactttcaaagtaagtggctaaggaaaattttgctacatctttcatgaatgtcacagaaaaagagacagtttgaaaatggaaatttttccaaatcttattgaagttttgctagtatattttactgagaattgagcaatgatttttgagatcttcattatgctgaagattaaaaataccaagttgttgtttctaaactcatttttttcagagaatagatagcttttcagcatttaatatgtacaataaattgcactgtggcgatacacagatgaatctgacacagtgtctattctatttaattaatgtcctgatataaaacgcactttagaaaacattaagcattataaggggtaaattattgaaggtgttcaaacagattatgttcatatatagcgattaggaaaagccttgtaaaaattttggcattagttggacctttataatagatagcacttagaatggcaagagaaaatatggtgccttccaaatagagggaaccacataaatcacgtggtagaagacacaagcaatgaacatagaatgcatggcctctttttattgggtcgagtgattttatgaaagaagttaagagaaatgaggttgaaaatgcagtttgaggcaagtcatttcataccataataaggagtgtgggttttatctgaaataatttcattgggtaactttaaaacaacttgttaaatgatctgatcggaaattctacatagaagctactgcagatagcaagccttttgagttctactttttttcccctttcaacaacttctacgtaagaagaattaaagtccacagactatcagaattaagggaactttgattttcttcctcaaaatgatgcctactgttaagtatgaaaggttaaccttactccaggaaaggaagagtaaatctatggggtcaggaaggctgttgtggtgaatggataacttaatgaaatgatcaaatagtcctgaatgatgttaattagggcaattttgtattactataattgctttgtatttattgaattattgcaatgggtgagttactagacagaaagaaatctatgcagtacgctgaccaaacactgaaaggatgacagaattggaatgctcttggctgttcaattcactgcttaagcagtctccaaatacattaggctattttttttctttttctctttttcttcttgctcattatctgctcattgtccttggatgggacagttccttatttgagagtatatcacatgttcagatctttttcatataaactttcctggcagacactgattctacaagtgttgtacattgtttaatgattttgtaaaacagatatttactgagagactgcagtaagacagactcattacccaagatcagtgaacccactgcatgcaatagatgaggaagcttctctcccataattccgaactgaaatacaaatgctgcctttagtcgcagaagttaaaaccttaaaagtttgtgttgaatagggaatgtcattgggggacatatcgaaccatgtgttaagatgtgtgaatggaagggtctggagaaaagagagaagattggaagagaaatgtatgggtggtacatgtagggaatagggactcaaagggaatgtctgagcaatgggagacactgtgaggccatgggatgtggcaatggcagcctcagctcatagtacggttacattatttattctttttagttttccagaaaaaaaataatattgccaagtatgccaacctaaataacaactcatgtttcaacactgtattttctaggttgttactggcaacttagaaagcctttactttggaaagagtgcttgagtggtattgaggttcccacattggcttagcaaagtcttctttgataacttacttctagaattatattaatgaacagtagtaacttgctatttcaaacatgatctttatggggaaatgtgtactgaactccagtaaaatgacaacagcatatatgtccacaccatgacagtcttttatgccactggaaaatgttcagaagtggaggcttcctgccagcagtagtggacagaagaatgaaagtaagagtcagattttttggaaaagcatttcatagctttcgtccccggtggctttggaggaatatgccacttctgttactgtgggaagtgcagtcagaaataatagtaacagtggtagctgccagggataggtctgtggactttgggaactgaagtacttgaatttgctatctttatcttgattggaatctatgactattttaaacactttctccaatttacaacggcttctctaagaaaagcttcacagctttctttcagaaaagctttgagaggtaggtttgattggcctagttttattaatgatggctttaaagcatattgagattgaggctgtcactgccaaacatagcacctctctttgtgaggccctatttctccaacatacacatttctcactctctgccactttttcagctgtccagtttctctgctgatctgtaaattcagtcatggaggaagaataagcttaatataatcttcttattagaaagcttttactgcgacaaaaaatccccaggatcttagctctaagtctcttcaacccctgtctataggacctacgtaaagggcaaaagtgtaaaataaataaaaggagataaaatgaggagaggggcaaaaacgaaagaattacttattaggaaaagtaagagaatgtgaaaaagaattatttgcaatgtcaaggtttacatacttctccaggtcaagtttatttttctccaacattattaatgatttattgaatctgaaccccaagcataattctgttctaggcagtgaggagtcataaatatgatagaaaatgttcttaccttcagagtggttacaatgtgatagaaaagtgtatatttataaaatattctaagttatttcaaaatagaattgagaatgtgacaaaagcataggctgtagaaaaaatggttttaggtagattttctctgggcagccccaccttccagtatcagtaaaaaacctgtgttgaaaattgctaccagacaatctctcttgttgagcatgtctaaaaaagtttcatgcctatcagttttgtattctatcacatatcagtatggtgcccttaagcagattccaagaggacctcctcaatcggaacatatcgcctcataaattataggattaatttgttttaaagatgccaactttctctcttattcaggaatgctttttttctgaaaatatacttagaatcttagtagatactctcgtgaatttcatgactaattctaatttgttcaataaactgttgattaaattacataaaatttgggcacactggataataagtacagagaactcatccctgtcccttcaaccttgctgtgggagccactgttcttaattttctaaataattccagtgagtacttttacttaaattatttgaataattccacctgtgcaaacctgactgcaatgggctgttaacctagaaaccctgagtattagattatatctgaaataattgccaagcttattgtttagtttaaccctagtttaactcagatataccaatgcctcattatgtttgttaactctattctgattcttcacatatgattaattatgatttattgagaacatcgttttccctctgtgtttactacagtccacagagtctataggagcggaaatctaatgggtttggtgttcactggagttgttcctttgaaataattaaggctttattttaaacttagcaatagggtaaggactgccagatatttctttatgtacttgaataaaatttgcttaaattcttcaaatctctggtctcaaactaattgatttctctgatgcagtgcttccttctcccaattgtgtgcctttaaatgaaaaatctctcttctaaccctctagctataaggagtttgccaaaggcaaagttgttaaccaagatttttattttgacccatagttccagctttcttttcgttttgacagttaatatgaatatacagaatctcagtgtattaggctattcttgtgttgctataaagcaatatctgagactgggtaatttatgaagaaaagaggtttaactggctctgtaaggtgtacgggaagcatggtgccaacatctggttggcttctggggaggtctcagggagcttacaatcatggaagaaggtgaagcaggagcaggcatatcacatggtgagaacaggagcaggagagggagtgggggaggtgccacacactttaaacaaccagatgttgtgagaggacagcaccaaaccatgagggagccttccctatgacccagattccactagtctctgccttcaacactggggattacatctgcacatgagatttggagggaacatatatccaaactatatcattccaccccgaacctacaatctcatttccttctcacattacaaaatacaaaaatcttgtcccaatagtcccccaatgtcttatttcatcccagcattaactcaaaagtcctaagtccaaagttccatctgagacaaggtgagtcccttacacctatgagcctgcaaattcaaagcaatttatttacttccaagatgaaaggtgggtgcaggcattggataaacatttctgctccaaaaaagagaaactggctaaaagaaaggggccctaggtcccatgcgagtttgaaacctggcaggacagtcattaaacctcaaaacttcaaaataattttgttttactacatgtcccacatccaaggcacactgctgcaaggggttggctcccaagggcttggacagctccacctctgtggccactgctctatcaggctgttgggtgtttttccaagtgcaggatgcaaactgctggtggatctaccattctgaggtctctagggcagtgtcctccttcccccagcttcactaggcaatgccacagtgggaactccttgtgggccctccaaccccatatttcccttctgcacttccctggtagagcttctctttaagggctctgcccctgaagcaggcttctgcctgggcggccaggcttttctatacaccctctgaaatataagtggaagctcccaagccttcttaactcttgtactctgcatgcctgcacgcttaacaccaggtgaaggccactgtgttggtccattctcatgcttctaataaagacatacctgagactgggtaatttataaggaaagaggtttaattgactcacagtacagaattgctggggtggccttgagaaacctacaatcatggtggaaggggaggcaaacatgttcttcacatggaggcaacaaagagagtgccaaagaaaagaggggaaaaccccttataaaactgtcagatctcatgaaaactcactcattatgatgaaaacaggatgaggggagtgaccccccatgattcaattttctccacctgctctctcccatgacacatgaggattatgggaactataattcaagatgagatttgggtggggatatagccaaaccatattattccacccctggaccctcccaaatctcatgtgcttgcaatttaaaatgcagtaacgcccttccaacagtcccgcaaagtcttaactcattccaacattaacccggaaagccaagtccaatgtctcatctgagaaaaggcaagtcccttcttcttatgagcctgtaaaatcaaaagcaagttagttacttcacagatacaatgggagtgcagacattgggtaaatacacccattccagatgggggaaattggccaaaacagaggggctacaggccccacgcaagtctgaaattcaatagggtagtcattaaaccttaaagttccaaaattatctcctttgactccatgtctcagatccaggtcaccctgatgcaagaggtgggctcccacagcatttggccgctccatccctgtggcttttcggggtacaggtgctcttccggctgctttcatgggctggcgttgtctgtggctttacaggtgcccagttcaagctgtcagtggatctgccattctgggatctggaggacagtcgtcctcttctcacagctccactagatagtgaagcaatggggactgtgtgtgggggctccagtcccacatttgccttccacactgccgtaggagaggttctccatgaaggctctgtctgtgcagcatacctctgcctggacaccagggcatttctgtaaatcttctgaaatctaggcggaggttcccaaatctcaacttttgacttctgtgcacctgcaggctcaacaccatgtggaagctctcaaggcttggagcttgcagcctctgtacccgtggcctgagctgtaccttggtcccttttagccgtggctggagtggctaggagacagagcgccgagaccctatgctgcacacagtaggggagccttggcccaggcccacaaaaccatttttccttcctgtgcctcttggcctgtgataggaggggctgccacagaggtctctgacatgccctaaggagactttccccattttcttggtaattaacactctgctccttgttacttatgcaaatttctgtaaccagctttaatttctccccagaaaatggggttttcttttctatcatattgtcgggctgcaaattttccaaacttttacgctctgcttcctctttaattatttgacgcttagaattgtcttctaccagatatcctagatcatctctctcaggttaaaatttccacagatatttagggcaggggcaaaatgctgccagtctctttgcttaagtataacaagtgtcacctttgcttccgtttccaacaagttcttagactactgtggcctgggcgtcattgtccatatcactatcagattttggtcaaaaccattcaacaagtctctagaaagttccaaaccttcccacatcttcctgtcttctgagccctccaagtctctaggaagttccaaagtttcccacattttcctgtcttcttctgtgccctccaaaccgttttgacctttgcctgttacccagttcaaaagccgcttccacgttttcgggtctctttacggcagcacccaactttctgtggtaccaatttactatagtagtttgttctcatgctgctaataaagacatacatgagaccgggtaatttataaaggaaagaagtttaattgactcacagttcagcatggctggggaggcctcaggaaacttacaatcatgatggaaggggaagcaaacacgtctttcttcatatagcggcagcaaggagaagtgccaagcaaaagggggaaaagccatttataaaatcatcagatctcgtgagaattcactcactatcaaaagaacagcatggaggtaaccactcccatgattcaattacctccctctgggtcctttcacagcatgtggggattatggggactacaattcaagatgagatttgagtggagagagccccaaaccttgtcagccaccgaggcttatggcatgccttctctgaagcagcagactgagcagtacctgggaccctctgagcctgtggctggagttggagcagtcaggattcagggagtagtgttccgaggtagtgtatggctctgatactctgggcctggcccatgaaaacattttttctcctaggccaaagggtctttgatgggagtggatacctggaagactgctgaaatgcctttgaggccttttccccattgtcttgtctatcagcacctggctatttttgagtcatgcaaatgtattaagtggttgcttcacagcccacttggattcttcccctgaaaattttctaacacctggccaagctgcagattttttaaacttttacactcttcttccttcttaaacagatgttccaactttaacatcaattatttgctcctgcatctgaatgaaggctgcttgttagaagcagccaggccacatcttgtacacgtggctggttagaaatttcttcccacagatactctaaattatgactctgaagttccaccttccacaaatccttagggcataaacagaatgcagccaagttattcactaaggcacaacatgtatgacctttgctccagttcccagtaggtgccttacttccatctgagaccttgtaagcgtgaaatttcactgtccatgtcatatcagcattttggtctcaaccatttaaccagtctctaagaagttctaaacgtttccttatcttcctgttttcttctgagcccttcaaactcttccaaccctttcctgttacccagttccaaaggttcttccacattttcaggtaatttttagcaataccccactcctcagtacaaattttctgtattaggacattctcgtgttgctgtaaagaaatacctcagatggggcaatttataaagaagagaggtgtaattgactcacagttctgcaggttgtataggaggcatggtgctggtatctacttggcttctgaagcctcagggagctcacaatcatggcagaaggcaagggggaagcaggcatgtcacatggtgaaaacaggagcaaaagagggagtgagggaggtgccacacattttaaacaactagattttgtgagaggacagcaccaagctgtgaaagattcttccttatgtcccagaaaccacccaccaggccccatcttcaacactggggatgatatctgagcatgatatttggagaggccatatatccaaactgtgtcactcagtatggcatttcatctggataggatgtacaactaagtagaagcccccttagtttcagatgttgagtatttttttcctaagttacataacatttggtctacattagtccattcatataacataggtatatgccttgatgatataacctattttgtcttctcgtttaaaatcatttaatagaatggatttcaagtcagtaatgtcaacagaattgaattcaaagttataaagagtcctagaaggggtttttttgttaagagaaggattcaaactgtggaaaagagataggatatatgtagaattccacttgcaattaaaatatatgtaccgttattttctcttttcctctactcttgtgattacttctattccttaaatggaaacagctgtcattaaaacgtgaaaatatttctgtttaaaagcaaatatttattgatgctaaaagcatcaaggaaacaaacacactttcaagttaaatttgttattgtcatggtacactgaaatagattttgttatactttatatgcctgaaattagtatgctatgcaaaaggattagagtgaaagatttaagcaggtcagcagtgaagatgctgccagtagctggtgttaaattgaacgtttaatgtgtgtcagctatatgaatttttctctcttaattttcatggtaacttgctgaaataggtaccattcctatttaatagatgataaagttattcagagagtttaaatagctgattgaaacgtaggataacaaagacaataatccagaaacaaaattgttctagcttacacactgtagtatccaagttggcaaaaaaaaaaaaaaatctttaaaatgttgttaaataaattataattaaattgaaaatcaccctaaattgaatatagaataatttgtaataataaataaacatgcattcaacatgttaaatgagaaaaagcagattgcgcacttcaggtataatgattctattttatttcatgtgcttacacacattgggaggctgagatgggaggatcacttgaggccaggagcttgagaccagcctggataacatagtgagatgagggcatctctactacttagggcacactggcatgctcctgtagtcccagatactgtggaagctgaagtgggaggatcacttgagcctgaggctgcactgagctgtgatagcaccactgcactccagcctgggcaacagagtgaggccctctctcaaaaagtaaataaaaaataaataattgtgcttacatatttatcttaccaatgaagattgagttcagctgcctgtaacagaacaccaaaaattgcaatggcttgagcaaagttaagtcatttctcttttatatagaagaatacagaggtagtcatccaggacagatagagttgtggtcatctatttcttgcaccttgctaacatttgtcttccaacctgaggatcattctgtgatctacaattactgctggaattccaatcatcctgcctacattcctggtgcccaaagggaggaaggaatagcaaaaggccgggtgggtggggtggctcacacctgtaatcccagcactttgggaggccaaggtgggcggatcacctgagattgggagttcgagaccaccctgaccaacatggagaaaccccatctctactaaaaatgcaaaaaaattagatgggcctggaggcacatgcccgtaatcccagctacttgggaggctgaggcatgagaatcacttgaacccgggaggcggaggttgcagtgagccgagatcgcaccattgcactccagcatgggcaacaagagagaaacttcatctcaaaaaaaaaaaaaagaaagaaagaatagcaaaagaaacacacttcatttatttgtacccatattagtaatagtaccttatccagaatgaccctagaaaaccatttacttattgttcattggccaagaacataattacatggccacacttagttgcagggaagtataggaaatatttatagtctgtacctagacatattgctgccctatgtacctagacatattgctgccctaagtactattcttggatgaccatttagcggcctctgtcatgacatatttgtattgaatgaatgatgatattaaaaatacacatatgcataaacatattcacacaaactatatatgatatatgctatatagcataattttattatctatgtgcatttttctttacttacaaatgtttaatttggtcatacttgatttagtatatctaatagtcgttataggtcagtcggtcatatgtttctttttatttataatttaaaatatgttttaccttatataattacacttttaaaaatgatatgtttaaaaactaataaatttgaaaatttatacaattcattcacgcttttccataaaacaacacttctggcattaatgagtcactgctttccataaagtatacataacaattatatgtatttattacacattctatattatattatatatacattaattatgatatataattgtatcatgactatgtataacttcatggtattatgtatataacatcgtggtattattttcaagccttttgttaatatcagactgttttacatagcaattaggaagctagaaatgggttcaaatcattccgttggtaataatttgaacttacttttctttcatggcatgaaagtttttgtgtgctactttttactattcctaaaccaagaaacgtgaagatcatgtgaatgtatttgctgttcaattggaggtcagacgttcaactcaagaaaggcttggcgcaagataaatcactctgctgtgaaatgagtccataaacacaatgcacttgccagccctcaaacaaagtagatttacaagtttttaaaaatctcagtgagaagtactgttgtttccttgagtgtaagttactcttattcatgaatatgtttaaattttagaaaactggaccacaaaagtctatcctaactatagtagtctgtgattaaaatggcaaaagcaaagggtgtatgatttttaagctcattttagtgctattttctagtgttttaaatttttttggtttgttcttaaataggttttaattggaagtgttcttttgagaaatggaactaaaactttgagtggggcagtatacttttaaagtcagagtctatccttgggttcataagttcattcaatttggaaattaaaagtagaggaaactgacaagggagttggggcgtgctgtagaattactctcaaagctaaacatggagttaaaactgtgtcaaaaccataattagtatttgcccttgaattgtccttgttaatagaagtggaacagtggaaaatactgcatagaggcattgtctggaaactgcatttcatagccaataaattcaaaccaccttagtggaatataattatgaggaggagctatagtctctgtggctgaagaaaaaacaacaacaagaacaacaacaacaaaaaacgcagagcatgtcttgctctacattctaacttgcatcatggaatccgccggatctatgccattttggatttcattgccaccggttgaaagtggtagatttctttttcttaagtcggctagaagacctaattttagtaagcctaaagggcactgagcaatacaactactttggtggatcgtttccagtttgaggattcctagtgcacaatcagtgaatgttgtatggaacgcatggtgaagaaatacggtttagtgaatctggaaacttaaaaaaattggccttggcatcgtgaggaattcccatttggccttcagcatttttgtctatgttggcttttctgtcccaagactttctataatccaatttatcacttgctttttgggttaaagggaaataaaatttccacacttcttcaatacatgtgctggagaggacaaggggagggaatttattttgtgtgtgtgttgtaaaatcagaagcaattgttgaaaggtgatgaacagtttgaaaggtatgttgttctcttgtactacatccagtggttactatgaagtttttctcatcactcttttgtatcctttcttaaattctgctgtgtggcagagtatcttatttatctccatattaacatgccttttgcaaggtttagttatattattgcaactgttctcaaaagatacaagcttcctcctaaaacacgtcacaatcaggttttgctagacagctactaacagccttaaattaaacaggatctcaggatgtcttgtcagtttgggttttcagctgcagacagttgacaagggataaagaggacagaactaatgccacatgccatctccctccaaagagagaatccttgacccctgagtttaccattctcatttttgagattccattttcacttctaccacatacaaattgctttccttgtttttaacacagtgaagtaatttgaaaaaaaaatctgataatgtatctcatatctctatgtcttttaataggaagagggcacatattaattcaacgtattcatttgcaagaacacaaaatcctggacttttttttttaacttactgatcattatatatctgagaaatttggtgtaacaccaagtcttttgtcatcagtagctcccattttttaaagacttctatctctatattcaataaatgtcacaattatttgctatcattattttaatatgtttactattatttttattttaaaatatgttctcattttcatatacttactattttatttttagtttaaaaatattttttcagaaacctaaaatgtcagtgaatacaggtaaatatttattcattttgactacatagaaatctaaagcaaatattgattgtgatatgtacatctacatattaatataacatttttataaacgtattgtttctgtttcaaacatgagtcttggtcaataattgatataaataaaaattcaagttttccacaaaattttgcttatgtaaaattaaataaggtaacctttatattcagtcagttctggctcctggataaattgcatgcttagaaatttcactttaataaaataaaagttttctcctcatctgtaatgtattctcccttttactgtactggcatctacatattgactgttttcatgaattatttcttcccaagatccctacaaagaagtaaaactcattcataatagattgtatattaatccccaaattccatgtaattctacagaaggaaaaaaacataaaccaaaatcatggtacttgcagtggaagaagcataagcatcctacatttatacccttttccccataaatacatagtgtgactggcagcctgcacagtaatgattaaatgagacaataaaatcttagcaattcttaccctgagtctggaagtgattaccgtgtccaagagcaagtcatttcctttttctaggtgtagtttttttattctacaaaatactaggaagagattatctccaacagaagtcacatcttctgggtcaaattaggatcacaaacatgtgtttgtgtattaaaatgttttaaatttgaatcagctgacaatacttcaaaaattgggagatttgatattaatatcttgtaacacataatgggtaaaagactgcccctggcaaaagcctgcatctctggttctccagaagccccacccttcccccttgctaccagtcacttaaaccaagtctgtgttgtggcttaatgtctaattgcctttttatttaaaattctgactttggcccctggcctagaatgaccattaatggtatatttagccatgatatctatgattctttaaccaataactgcttaaggctatccttgccttgatgtttctcccagagcttgcctagtcaagcttcatcctcttagttaattatggtcctctatagaatatgtgctattctgtcttttaaaggcttttccagggatacatttgacatatttaaacatgatagctaggtaagctgtttcaaaggcattatcctccataaacattctactcttgtataaaaagtcatttcaaaatatactattttactagatttattcatgattaagtcaagagttgctccatcggattagtatttattttcaattgccttccttatatacatgttagatagcgttgcactctgaaactggatttgaaactttatttttttctttataaaatattagtgcaaaaatcacaaagggattcaaaacacacacacacacacacatactcattattcaatagattttgtatgtttgaattcaagaaatgatgagttataagttatatctgaaatgtccaggagagtgggtcttaattcagaaagaaaaaaatggaaggtagttaaaaatgatttccatagtaaatactcaatagaattattcactaagaagaaggaaattatgttgaaaacttaaacttttgaggcttttcaagagtgttaacaggtatctgtgacatattttttagtactttaatttggtggacatattcttataatctgagttacaaatcaatttattaaaacttcaattagtttttgtgaaaataatgctgtacaataaatgatgcaaaatgtcaattgactaaccaccgacaaaatttatccctcactgaaattcctgtatgttgttaatgtgtccctgctttgggctgtaggttgggttcaggtatctatgtgtcttttaatctggagcctatcctttgctggggaataatatttgtacaggatagggcaggatcgcataaacaagtcaaaccacacatgtgcatctacatcctggttggatacagcttattatattaactcacattcgattagttgaagcaagtcacaaggtcaagctcaaagtcagtgaagaggagcattatagaggcattgtggctaaaccacaataagccatttcaatgtggggaaggaaggaagaattgtgaacacataatactatctgtcacatgaaatatgcttggtaatttgcattattttggatatttcacataacaaattcaaaatatagcttgagaaagataatagacaaagatgtcacatattttggaatgatgtttaagaaagatgatgctgtttcagttctgtaagctcttaatatttatcaatatgtcatctttgttttaaaatgtaaagctttatctacatgatgattgtgaaaagtgggtaccaagttttgggctatgtaatagtacatgaaaggaaatagtcataagaaaatcatgaatttagaaaaacaccattgcattgatagattttattaggggtgtcaaatgtttcagcttataggttagagaaatataagcccctcttttcatactgctatgtggtatgacttgctgttattataaacttctgtacattgcacttgagtttgatgaagatccataaagatttagtcattgaaacataacagccattgtgccacataaccttgggttgaggtctcaattcagagccaacttcagacagcaccatgaataaaatttgatcttgccaatttcacattccccatttctcccattcaatatgtacacatcgatgttcccaatgtctttattttgtcctttggctttggattccatatatatatatatatatatatatgcacacatacatatatatatgattctcctttaatttcactcagtatcctgtcttacccattttgaacatctgtttaataaacagttattattaggcactctgaatttaaataatcaggagacatggttccctaggatggtggtattcaaatgattttacaaaaatcctggcagattataagaaatagattttaattgcagtccactaaatacatacatatacatgcatacatgaagcaaaaatttcacaaataataataaccttactacaggtatacattatgatttattttatttcattgggggtgagtgttggtagccactcactaaatgaatgtcagtccctagtgtttctgaattcagtgtataatagcactttaagattttaggtttaatggtggccagggataagggtcagggaaaggggcagctacacatatctccagtattattaaatgccaaataaatagtgcagataataagtgctgaagtgtttagaaaaaggggccaggcgcggtggctcacgcctgtagtcccagctactggggaggctgaggcaggagaattgcttgaacccgggaggttgagactgcagtgagctcagatcatgccactgcaatccagcctgagcgatggagcgagactctatttcaaaaaaaaaaaaaaaaaatttagaaaatgaagaagcttattttggctaaaatgtaatactagaagttatcaaagatgaagaagaagaggtaggacttgaatttcatattagtgtttcaaaatatattaacatgaggaggtaatttaattattatttaggaatggttatcagcaagacatattttagaagctctgtaatagtttcgagggattaagtataggagttcattttgggaattactgtgagataaacatgaaacgaaggattgattatgtattatatctgaacatgaattccaggccaattatctcaacatttatctttcatgcaatggagattttctttgagtttctgatatggaagctagaatgatgtaaaaaatatttaggaaggggaattcgatatgcaccatggtcacctacgtgctattgtattttttatgtttttcttagatttttcaataaaaattctaccatgtgttttctggggcttgttagcaatttagtaggagttatattgaatagtactttaactcaagtgaaggataactaggtacactcttgagacaggtgttcattggcatatgatgtattcatttcacacattataggttctagccttagaatttttcatgttttaaaagcattattccaagcatccaatgtatgttgcgtttatcccatatgattttgtccagaatggttactgtccacagaggttttatctttgtctgtggtattaagctttttgaggacaatgcaaatggcttcatattcgagaatgataataatttggtcaacttttatgtactgagaaattaattgaagatttcaaaagactaaatagcatgaaatatttataattgctgtatagtgaaaaataatgagagattttcctatccttatacggtattttgcagagggtataagcaaaagctcttgtgatttttattcattttgggggggagaattggataaattatgttatgtgtttaaggtactggtttttgttttattgtaagcaaacttatttactttttatagtgctagtcgttatcaatgccagaggactgctgaattgtcctgttcccacctccagtcctataggacttcaccatctaaaaacaccttagttcccatacagctttgctctagagtctagaaagatgctaatgattatatgctagaaggaatcaagtaatatttggaggaattgttcttgtgtcttctagattatcattttagaagcaaatcatgctttctgtgagatgtccataagtgcctctatcagagacggattataatgctgtggtgttatgggtctgattctgtggggagaatttagcttactaatttcgaacatatatgcaatatgtatcaaatagtaagtgctgcaaagtatgtccctgtgctttaaaagggaattactgaagaaatttctaatttcacaataaaaaatattttagagtagcagggacttgtttttaggaaggaaatctgccatatattagcaagcaccattacattttaaagtgatatttttcaggcatgtaaagagtcaagttcttgaaaataagaacacctttattatcatgtaactgcatttcagcactgcatcgctctctgtattcccctctcctctccttgcctacctctctcacctttatttcactctcttccttctaatcttgtcactttgcttttcctgcactttccttcctcgaggcatttgtttatgcagtttctgtagccccacatgcttattcttctcctataggtaaacacaattccaatttttcaaaatccatctcaaatcacagagccttcacgatggctcccaaagcttccatcagatttaatttgatgtccccatatttgccatagattgtgcttttaaaaattgtagttatccttctctgtcttatttaatggtaatttatgtgtgtccactcatttcataatgctctactgtaggttaaggcctatgtctggctcacaaacatcttactcattgacacagagatttgcatagagcagacaccaaatagatagttacactgaatattttatgaatcatattaaaatctataggtggcttttaaccatactttattgatgttgtttaattagaagtctctctcaaaaacttcatatgctttgatgctggggaggatgcctcactcattgttgtatccgtatttgtaactaacatttattgagttccagttatgtgacagactcctactagctctttgcactttatatggctcatctcattgagttcttagaataacccaccagaataggtgggcagtaatagctgcagtttataggggaaaaaaaattatgagtcagaggctaatttactttccaaggtttgaagaggcagtaagtgacaaaaccaagataaaaactcagaaagcttcattactttctgcaaaccttgaacaatctagtgaatgaacgaatgtgtcttcagagttatgacataaccagcaggagaaagaaaccatcatgcgacttcctaaaatacgatgcattatttctttcaacaaattatttaagtaagtgtactatgcttagtagttatgtgaatcattatcttggattttattaactgtagggctgtagactttggaaagaaagatcctaatactgtgttcaggaatcaatgagaaacaaagatattagtagaaaaatggagtggaagagaggcagtgggtgtatcgattatgtactttggtgattatgatttctatgctatggatatttaaaattttattttcctcttaatcttcaatttccatcttctggtaacttctttagatataagaccaagacactttctttaccgttatatctgctagatttttatccagtgtattttaagaagtcttttttatccagtgccttttaagaagctcagtccgggtgcagtggctcacgcctgtaatcccagcactttaggaggccgaggcggcggatcatgaggtcaggagttcaagaccagcttggccaacatagtgaatacctgtctctactaaaaatacaaaaattagctgggcgtggtggcacgcacctgtagtcccacctactcaggaggctgagacgggagaatcacttgaacccgggaggcagagtttgcagtgagcggagaccacgccattgcactccagcctaggtgacagagtgagactccgtctcaaagaaaaaaagaaaagaaacagaagctcaataagtgttatttgggataaagcattaactggtttaaagctcaagattttaaacaactcaggattgggcattaaagaataacagaagctaccatctattgaatttttattaagacatttcaggacaccaggagtaagaatacagggtagctgtatttgttatctattgctccataacaaataattccagactttctggcttaaaactactcattatctcacagttcctttgactaggaattcagcatctctaatttaaggtctctaaaatgaggttccagttaagcgattgacagggtctgtcgtcttatctcctgataagactaggaggcttgactagtggaggatctgcttccaagcttacttgtggggtctcagttttctgctgtctgtgggccagagctctctttcagttgcttgctatgcaggtggcctcatgggactttctcatgacatggcaactggtttctccatggtgaacagtctaagaatctgtcaagatagaagccacagtgtttttataatctaaattggaagggacattccatcacttctgccactttctattggtttgtagtaagtcagaaagtctagcccacattcaaggaaagaggattatggaagggcataaataccagaaagagaattttgggtgactcccttagaagctgcctatcaaagtacttaccctgccattctgtctacttatcattgtatttctctttaatttgatcttgaggttgtaaagtggctataaactttagccctgccctgatggagttccaggggatttatttggctgtgggtatttatgatgtgcctttcactggatacttctttatcctagtggataacctaattcctgtgcctaacttgttactaggtatacttcacacacacacacacacacacacacacacacacacacacacacacacagacacacacacaaacacttatttatgctggcagactgacagtcacctttgcagctcttgtctgttctgccaagatagtcactctctgggaaagctttgaccagaagaaaaattgggtatggatgtattggtcaggagacgtagagaaggcagcacagcaaaacatatgaagtataagaagcagtttattactcatgagtccacgagagaagacggctactatataggaagcagggggcaaggttgcaggggcaatgtgctgaaccatcagatcaggagcagatagaaagaggacctgtggggccatgcctttattgagctatgggggttacccgttaggctttcccatagaggttattgattggctaatttaaagacaacacacatgaagaggggagcttattcccatgactctggtgttgacattaggttttgtggtactagctgtgggtgtgctgagctgtagatcagtaagatgagaatcaagcagattaccttacaaatgaccacgtggggagaggaagatttaactgggccaggggtgagggcagggacctatgtcagtcctaaagtagatgctgaggcagcaactatgtgaaacacatttatgacacacatgctcattgcagatactagtaattgatgatagcattatttcaaaatgagacaagatttgggactacaaaacattctcgaggtagtgttccaggaagctactgactgtcaattatttaggattggaactccatttgaaatctatttgttctttatattgtttttttttaagtttatcttcattaaaaagctgcaaattaggtattcatttttttattccactttggagaaaacaacaacactaagaaatgtcaaaattaatcattgatatatttgtgaccagtaccttcaaaactagttcaacctactgaaaactactcaagctctttccaccacataatagcactttcagatattgtttttgcagcttaaagggaatttgcatttaggtatgtgtacaatatcaacaaattggtgctacaggcacattcaatgttcttctttttagaggaaattaaattcaatttgattaggttgatgtggacaacattaaaataaatgttaaccttattctgtatttatgaatcaatactgatagttttaagatacctggccattctacttgttggtaaggtcttggaataaggaaatcttgacagaagttttgaagagtatattctttatcatttcaaactgtgaaaactatgcactttcctaagagtagattttaaagtcacacaagggatcatgctgaaaactgacttctagagtctttgctcagcaggttgttgcattttttttctttactattgaacactcttttgttcatgccttttttcttattgcttgcagaaatgtgacaagcttcaaacttacacagaaagaataagtagtagagatactaggtatcattgcacagcccagatgtcttttgaaaatatttattcagctgaactagaatttcaaaatctattagaaaggtaaaatatatcttggaaaacaaaagcagattttgaataaaacataggtaaaaaaacttttaagtaagaaaatatgaaaaaatggcaacagctttaaatgataacttgatggcttccacagaataattcatagtgtaggtattttttattaaaacttgacaaatattctaaaaaatgtaaaagtgaaaattaggtattttaactgagaaagatgaaattggcaccatctaaaaaaattttcatgagttccatttgtgttaagaaaatatttcttatttaatcaaatacatgtgcaaaatgttatcttaaaatccttttagagttttgataaagaatgctcaatatgagcatacatattcagccattagttatattcacattctcttccagaaataatctgttaataattaaatgtgttttataaacacttacataatgaaactcaaattagcttctcagataaattgttgttgctgttgttcagctggtattgttataaaccatcattcatataactttattatattgtgagtgttttctttgaaactgatcaacctcagcatttaggatatgtggactattagatggagaaatgaatatttgccttagcatagtaataaatattgttagactgacacaaatattagcctgcactcatagtgcctaaaataggccattccagtaattgcttagaaaaatattatttgtacagcttgtagaaatttacaaatgaacagaaaaactctgcatttgacctaggatatatgaattcttcaaataataaatatatcaaatatattctgagtttgaaatagtctttaccttgagccaccaaaaaggaaaagaaaatagaatcaagattacttgttaattttcaattttggggtgaaaaaccttattaaacttctccagtaactaaatcacataaagttcttcagtacaagttagattgtggaaatagttcatgtagttattccacgtctccttctaacaaaatatcaacagttcaaatatccagtttccttttcatttatgcaccattgtagttgctaatataaatgttggatctttctgcctcccactcacacctccagcccctcccctgcccacgcacctgcactggctcacattggtgctctttttctgcgggctgcgctgagcagaaaaggtgaggctattcagggttctgtaatgctcaattccatgttccgtttcttttcctcagaaacagttgaaacctatctatggatgaaaaacgcttcataatccaaacattacttcaatcagatgtgaagagtgggtttgctgcactgtaacatgctattattgcttaggtttatttgacaaaagtgaacaaccacaactttcaggaaaaactttttttttttgaattttatgtgagttgtccttttggaaatagatagatgagagagagacagagggacaaataatctgtatgaattttggcttttctcttgagtataaatgtttatctttcccccttcaatgtaacttgcttggatgttcaagtgtggagtacatttcttttctaaaagacaacatatttttcaattttattcattgatttatcactcaaaacatgcacttgaaggtactcttagtactctccttcatggccagtttatctataccgttttttcagagtttcttgagacagcttgcttttttttgtttgtttgtgttttttgttttgaccgagtctccctctgtggcccaggctggagtgcagtgatcttggctcactgcaaactccgcctcccgggttcacactattctcctgcctcagcctcccgagtagctgggactacaggcgcccgccaccatgcctggctaattttttgtatttttagtagagatgggttttcaccgtgttagccaggatggtctcgatctcctgacctcgtgatccgcccgcctcggcctcccaaagtgctgggatgacaggcgtgagccaccgcgcccggcctgaggccgcttgcttttaaagagctctcgcaaacaggtagcataggtgactgccttttgacctaaaatgtgatattttagaatatgttactagaaatttgcaataatgttcttaaaattattaatcttattgatgtgtttctggagcccagtaccaaacactgatcctaaagattgaatttggaacgaggccaatttagtgtttccctaaactgttttgggtagaacgctaataataatgccatgtgcttttactagtatttcatagccaaatacatttggggattacagagttagcccactcgtagccgtcttgtggactgcacggagcctttactgtgcttgcatgcatcatgcacccacctctccgagagtggtgtcatatatgtccattgattggaatgagcaggttactcctgcttccctctgtagagcgcatcatgcagaattgtttgtgtgtgtgtgtgtctgtgtgtgtgtgtgtgtctataccactttggatatcactcagttaacagttattgtctaaatcattcttgtgataagaatgataatcttattatataaatgatagaactatacttgagaatacagcctgattgttttatctatccattttatcattaaaagtgaattgaaaactttactattatgaaccctgtcgtttcctattgaggttctttaacactagaacctgcagaattagccatactttgacattaaaactattacattgccatcctctctttttccctggtgaatatttaggtgcactttgagatctggtattgctctagtggtgtgcctatttttttttaatattttcatttttgtttaatctacagagaagttccgagatcctccagagctctgatgggaagaattgtatagcgtgtcccctgccaaaagttctaataaaaaatttacacagcggaggctttgattaaatgaattattcattgacaactatccatcagggaattagaagtttatggcaacatgagctgtggaaaatagaaagaaaaattacccattactaactttttaaatgagaaagtcagaaactcagattgaatgtgaatttaaccctgcacatggaaagacactatgcaaaatattgagaggagttacataacctttatgcaatttattacttaataagcacataattggctgctaattaacagttgtagcatctttctttcttgtctttcctctcgttaagcgtaatattatgtgtagaactagcatagtgtggtttctgactttaacattcttctgtaagatcacttgtgttcagcacctcgcacagggttctattcacagaatagaatcctattttgttttcttttatattagaaatagtccatggcatcttgacaaggtgttatgaaccagagaggaaaggtcaatgatttaaaccagctttaggagaagcatatatagaagttgtttctcggctttctggaatgaattttaacagccacctataattgaaagcatttcatgcagggcatttcacaaaatggacattcaaaaactacaggttgacctgtactgaagacgtgaaattgctttgtgcctttgagaagtactcttggataaaccatgccattgtctatattgagttccctgattaaataatagtctctctctatctctttatctctctctagctagccatccatctatatatataacacatgcacatactcaaataaatatttacataacgaatctatcgatgtatattagtaagtactatgcattcagcacatgattagggtgcataatctcatatgcacgttgcaaaaatctttgaggggtagtatcattagtaatatttcatatatgacaaaactgaggtttaaagagtttaagggacttttccaagttcacatactaagagaaacagttactatataagtcacgttagccgcaaaggcaagcctttcttctttttttggatattatataaaaattatatagaaaagtttctttttaaacctaagccatgggaacaattcttcagttttcattttattctagtaaatttcttttcttttcttttttttttttttttgagacggagtctcgctctgtcgcccaggctggggcgcagtggcctgatctcggctcactgcaagctctgcctcccgggttcacaccattctcctgcctcagcctcccgagtagctgggactacaggcacctgccaccacgcccggctaatttttttgtattttttggtggagacggggtttcaccgtgttagccaggatggtctctatctcctgacctcgtgatccgcccgcctcggcctcccaaagtgctgggattacgggcgtgagccaccgcgcccggcctattctagcatatttcaactcttggtggcagaaacatctttcttaaatttcacccagaagtgaattacatgcccaccctttctttttccggatggatatgtggagagaacaattatagttctactttgctcttggctgtaggtatagttgttaataattagaaaacactcgaatggcaggttgccaattagagaggggagtataaagatacacagaacccgggcaattcaaatttgggacaatcgcctttaaagacattgagagttcactaaggttgctgatgaatcctgtcacttgtatcagtcaaaaggataatttgtaaatagcctgtagagaatcaaaggccagaatatactctcttttctgacaagcagaaaacacattatatgggctaattttccctgcatttttatcttaaaaaaaggagatgggtttctaattctgcaagcaaatatatattttttctaaatgtgagctatttcgaaaaacctaaaaccactcatcctagagcaagaacagggctaggttgagtgtccaagagaagactgtcacaggacctggcacattagtgagaaaggtgacattactccaggggaacttaatgatgccatttatttcttgatgctctgaggtacagcccccatttagacagattactctgagaattttgtaagatatccaatgagatacaatcatctttattggtggcactgtaaaggcaagtatgagagattttggcaagatcatctttttttagagacacatttatcatattcctttttaccttctttattaagtaggtactaatactatttctgattcactgctctctactccaaggattgcactaataggaaaattttcataaagcttttggctaagaactcctgctattgacctatgcccctttgtgtctaggttgatccagaagatacttcagcataaaaataaattccaacaaaatttagtttcaaattataaaagttgatatttctgctttatttgtccaaaagaggttctaaaatgaaattttctcaatttcaggtccattaaaaagtctgaatcttataaatatgcatagcttttataatacttataacttagatattaagaaaaatcaagatgtacattattaaagaaataacatttccattgttttcctttctcagaagtgggataaacaagcactgtaaactgaaataagcaatgcattctcagttccctcccaaaagaaaatactggtgtgcctgacttaccatttcagaaagtccagaaaacgctgcaaactaggcaggcagtcaagtgcaatggcaatgaataaccttataaaatttccagactttaagactgtcagtctggaagactacactatcttttagcacaaggtacttttggagattactctagggatcttagagaataattatacttaagtcctgccagggcctttttttttttttttttttttttttttttttactgtagtcaatagtacttccattgtactccttacatgacattatgttacagaagaaaatgttttataacaatgtcatttgagtgcttcagttgttacctctccttgaatacatatgaaagaataattacctttgtagtaaaggacattctagttatacatctatactttattggtttcttcatgtttttctcttcagaagtagaaacttaatgaaaatattgcgtaagtagagagcagtttatgacagtatttctttctaaataaattaaagattttattatatcttgaaatatatcacatatgtaaaatattaagtataatgtttgtgatcattttgaaacacagacttttaaactttaataaattatatccaagtaacattttaaatttgttatctaacttctactgttaacatctgaaaaaaattagaattggcagacatgcaagatgatgttgactttgcagccagaaaatgtggaaaggcctcaattagtatccctgattcacacttacaaatgggtgtttcagtgctgtgcagtttgataaggtagttaaggccatagtttgggagacagataggcatggattccagtcctggctcaggcatttctacttacgctattcgggcatgtcagtttttctttctaaggctcatttccctgtgtgtccatgaggaaataatgtgtttccttggtagaaagatggttgtgagggttcagtgcaatcatgcatatgcatagtaagtattccatatatctcaatatcatgatttatttcttgctacacaaacttacagtctactcactacctttgatgtaaagctgtcccactgtccttctgtgctttttctagaggttgagctcttccttcatttctggaatagttactgatttcaccagtaatttgccttttagatccgttgttacaggtgcctttttgaatctgactgctcaaaagctttgtccattttgtgttgctataaaggcatacatgaggctgagtaatttatgaagaaaggttttggtgctcatggtcctgcagactgtacaagaagcacggtgccaacatctgcttggcttctggtgagggcctcaggctgcttctacttatggtggaaggcaaaggggagctgactatgcagagatcacatggggagagaggaaacacatgggggcaggtgggtgatatgccaggctatttttaacaaacacttccctgggaactagtagggtgagaattcagttgccccaagggaggacattaagctattcataaggaatccgtccccatgaccaaaacacctcccactaggccccacctccaatattggggtcaaatttcaacttgaagttggaggagacaaacatccaaactatagcagaagcctttttttgttttttaaagctttagctttacctgccatatataatagttcaagcataaaattcaatgtcttttagcttttttagagttgtgctgccatcaccataatgaaactatgagacctttcaaagagaagacaggtgtaaacttgtgttatctttgattaggttatgatttattagatttgacaccaaaagcgcaagcaatgaaagagaaaaattcaagttagacttcaccaaaattaacagctgatatgcctttaggaagcatgtaaactcagaagccattcttacatgactggctcatggacatcattgatttgaccagaaatggacattaaaaccatgggaggctgatgcagtctctcatgtatgaatttgaaatagacacaagggaacaccatgaagagaatctctgtggaccttaacattttcaaattttagaaaacaacattttactatgtggaatggacagggagagtgtcaatgagaaaaacaggaggaggaggaaatgaagagagtttggcttaaaatgttaccactcaaaatgcctagcatgaattggggcaggtccatgaactgcttgttattggtctctacccaataagaagctggctccagaatgcagttcagttgacattttcttttgtaagaaagattttctcaattaaaaaaaatcaccgtgttgatttgcgtttgatagaatcttgtcatcagacaccagaattttgggtagcatttttcttttttttcttttatcttttttctttctttctttctttttttcttcttctttttttttttttttttttttttttttggagacaggatttctgtcgcccaggctggagtgcagtggtgcaatcttggctcactgcaacttctgcctccttgctttaagcgattcttatgtctcagcctcccaagtagctggaattatagatgcagggcaccacgcccagctaatttttctatttttagtagcgacagggtttcaccatgttgaccaggctggtcttgaactcctgatctcaggtgatccacccactttggcctcccaaattgggtagcatttttctagaatattgacactttaagctttcttatgatactcacttttttctttcctacactgttatgcccagtgggagaaggttgcttctcttaatagttctcagtaaatgctgattaaataaactgtagaagggtaaatagttaacaagattctgaatttggacttgtgatttttgaggcaaaaataataggttgaaagacatgttttttggatcaacaggcttgtatggaggtagacatttataatcttagtcatactagtgagtgatggacattttattactgttttgcaaaggtatggacaaagtcttaagatctatgtcttctacttttaggcatgtaggtaaaaatgtcagtaacaatgcagaaagccagtttatctatttaaaaaatgaatatattggaagccttgaatatgaggctgagtaatgcaagcttttcccaggagaactgtgacttcttgaggcccaaagctgcactccggaattataagtcctgagacatagtctataaacaataagtaaatatcagtcctatagctcagtgttcaccactgatgacttctcacacataagcaatatcatgttaagcagatagatactcatagtcatccaatagtttgcagtgggaaaatagtttgctaaaaagcaagatgtcatatgtgttgttatatttttcacacatgttgagaaattatctctgttgaagatttcttgagttaaccttggggcattagcctttgctgcaaggtttgaaaaactcaatttttcccattcagtgtgatctattacaagctattctgcttcctgaatttttgagagtattgctagttattttattctcagttacctaagaagggtcatatgagggaatgttttgattatcctaaattcgtttctatggataacttcatatctttgttcagatctgatttcttccatagtcacttaaacttgagaattctatcctatcttccacaaaagctatcattgaaatagctgtgctttccacttaaaaagtgaaaaggttaatggtatggagatgaaactggaatccaatcctcataaacagtactgtcttttccatttttatgttgcctttttggtcacctagaccatacacaagagattttatttttctttttgtctgattgcttctaaacagatttctattacatctccaaatttcagtttctctcccactgttcactctaggataaagtggagttcttactttatttcaatagaagctagaaataggtaccttaatgaggcaactcttgattttatttcagaacttggtaaaacttcggcttttcatttcaaaaacaaaagtaagcctctgtgcttgctgatctgtgttccgaagacttattctccctgtgcacccactatttctactagctagaagtaaggcagaattcccgtagagtaattgtgtttcagttgtatttcagacaccacagacatgaaagcttcacagaaaaggttgcttcttcctcagtggagctcatttggtaatagatgccaggtgcatgactgatgctggtttgaaatggaggacccagtaatggctatatcgcttggtgaaatcgcatgagctcaccagaattagaatatgcccgtaggagtaaacataacttctcatttttgaaaaattcgtaacttctcacaacttttgttgttctcattgctattgatattgttttaataatattcatctctatcagtgcccagcaagaaaatatatgcaacaaatattagttgaatgaatgttttaatccacacagtaagagccataggatataaatatacatgatcaatattccactgcagaaaccactggatatcttaaaacattataaagttacgtgcagaaaactattgctgtgctttatgattttaaaagtaaggtgtatttataataaaatatttaaaaatactgagaaattttagaaattttaaaatagtgacccaagaataatctttagttttagtattaatttttacatatgtacttaaaaattactgttgttgttattattattacatttgtaaaatgcaattggagtatattcattactttaaggtaggagtggggaagtggtttacttgagaaaaatgacatctagttttgtactttttctcacgctaagaagtacgtagaaacaagcaatcaactgaataactttagtgtttatttttaaaagtgatatatatcccaacaacttgtaacttattctttaaataacagaatttaagaaaatgaacaatattagataatattacataatagttatgtctcacttttagtatttttgtctttctacatgtatgaattttataattaactattacaatttttagacttccaaactaattttcatgattttggttatctgtattggggtacaatttacatacaataaaattcaccaattttacatataaaatttgattagttttggaaaatgtgtggtatttgcccctggttttctgaaaatagaattaaaaacccatcaaatcttttatcccccttcatctcacttccagtagagatatacttcttacattttatacttataatgtcttacctatagaaactgatagaatagggcctttcacaatactaattatttcatttggtgtttacagccaagcagttttgctcctcagaggatcttaactgggaactaaccctcatctgtaactatagtttctcacaccatcaaactttacttaaaatgtgccagagcctagttaaatgtcaaagaagaggcctggtagcctttgtttggaaatagaagacagtatctactttgaagttattgtttctaaccaatagcatcctcggattttaacatttttgttttattttgtttcagtctcactgacaaaatacctttcccattttgtgccttaatttccggtttgaatagcaatatcttagctcaatctttaaaaataagcactgtttttgtcccttttactgactgtttgctttttttaaaaaaagtccaaattagtttcaagatcaaacttctatgtatatttagaatctagccttgaatatttcctaatttatactgaattccatttatgtatcattcttggattagattttctaatctggccatgtttttttctttcagacctgttactagctcactcttttctattcaaatcttatttctcatcctggcctatttcccaagtgcaaagacagcggggcttcctgtgtcttagggctgcccagagctgatgcatatcactcaattacggtattataaataatatttttagaagtatataataaaaatattaccaccttaacagcttaaacctgaatttgtaatcaggttagaattaatccatgaaaaactttgtgatatagagcattgtgtttttctatgcacaactttgttgaaattctagcacttgggaaatgatgtctactcaagatttacattggctaattcttctcatactaattatttttactatgttgattatttattgttttatattggttgatggtttttcttgaatgctcaaataagcagccattcttgataactattgcttatctcagatgtgaagtatataataacattttattactggttttggttattggagtttattttaactaggattttactcttagttcagtttttaattcagtctgaaaggtattattaccaggtaggggagaggtcaaataacgaacattattttccaatcattctggcaatctttaaaaatgtggttccctgagtatgtatgtagtcatgtaccacgtaacagtgtttcggtcagtgatggactacatatatgacagtggttcaatgagattttattaccatacttttactgtacctttttacatttaggtacaaaagtacttaccaagtgttacaactgcctgtagtatttagtacagtaacattcacagatttgtggtctaggagcaataggctagactgtatggctcaggtgtgtaatatgctataccatctagatttgtgtaagtgtactctatgatgtttgcacaatgacaacatagcctaacgatggacttctcagagtgtatcccggtccttcagcaatatataactatacatatgatactgggttgtgatcatttcccagttacaaacaaattagctatcaattttctccataatatcaaactcttatgtgattctaagtaagtaattggcagaaaggagaattcacattagtttactgaaaaaaacacagtgtagttttatgaaatcttgcctgttagtgatataccctattcgcttttgttgacaaaatgcaaattacttctttaatattactcttctccataacattctgatttgtttaaccttgtcatgtttctgttaaaccagttcaacagaaagggctcatccacttataaataatgcattatctttcaaaagccctagtaattttttgcttataatctctgggtagcttcagtaagtcaaaacatgacttcatattctaacttgtcaaacttttaagcatcaagcaatttttcctgcacttttaattaactgcacaaaatattatctgtaatgaatagatatgttaacaagttatgttagaacaggacaagactagcttttggctcagtggggtagaaaaaagtaaatatattcttattgctgttgttaggaggtagctatgttagaatgttgctatggaagagagatgctactgaattgggtgcagtgaggggaaaacatgggagttaaaacatgtgggttatacacctatgtatctaggataccatgcagaagaggttggaattagactgatggttaatcaatgggataaagggatgtgttttcagtccttgtcagatgaatttctactttatcctctggattattggcccttattcttctttcccttagaacttatcattcttcaaaattacaattatttctgtaatcatatcaaattatcagcttcttaatgatgtttcttacccactgtgttttagcatctaagatatggatgtgtagctaattgtcataatagctaactagcattcattgcacgttcatataatgtccagctctttgttaagggctgaaagctcattatctattttaggccccacaacactctgaagttggtattcttaggaattctgtgaatgagaaagctaagacttcaggaatttagtgataaatttaggtaaaagttagagcaggcccaggacctacgtctctctacagtgacatacatgccctgaactgctactccctctctttctcacattacctaggcagcttttattgtgctttgttatctttaaaatagcgaattaacacttgctatttcataagcttaaagatgcattgcctgtaatattggaagctgatatgcagctcaccacatatccaaaggccggtaataatgaacgtaaaatagggaagaaaagacagagtatactgggatggatcattatctctacatgttgatttattttaaaagttcctttcagtgtatattaacaccttggaatgtgtgcaagttacaccggtgacctttctgcatagaactccaatgagagaaaaggcaacccattgttagatgaaatgcttttcatttcaagcatgtaagcagtaccacacttggtggattaaagatcgattgatctcagcaagcaaagaacgttgttaaattgttcagtcctcctttctggctttctctttttgctaagaatggaaaaagagaaggccttggtctctgttgtctcagattcttgtacctagggctataattgctgcagataaaacccaagaacaattgggttgtggttttcaagtttaattacattagagctgcttcttttgccctatagtcacatttgcaatttgtgattaacatattagtgggaagaaagtaatgatagattgtagttaatgaagcattttctctatctgttgtttcttcaatgcctctttcccgctacaggataagatatttatgttaatttttatgcatgctgtagttaggtttctatatattatgtagggaaagttctgcattagctctaataaataaagtgttcagttttaaatcatggtctttgctctactttatttatttgtatttactctttttcattactgcaggaggaaacagactcagtgttttatttttataataaaatactcttactctaagaaagagttattatgcatcctaatactggtatgcaaacatcattaaagtttacacagcaatggtttttaataacatttggagatattttggctgatgcagtttttgtgctaatattttggcttcaagataagaaaaactggatttaatccttgctagaatgctgggaaaaactgatgttatttgtaaatgaagatttaaaagcatttaactaagcttcgttttaagatatacatgtagagccacatctttttttttactttggaattttaaaatatgatttatcttcctttgtcaggtagactccagagtttaaagtgaaatatatatatgtaatatatatataatatatatatattacatatataatatatatatataatatatatatatataaaatatatacagaaggctgagaatcaaaccagtattgaagcattcttaccaatggcaactgggatagtgtttgagaatgagattgtggggtgtgtgtcgaggaaggaggtaagggtgtggattaaaagttttggaggtgagatgatagacaaggaagaaaattttattgttatatctttccttattgaaattgctcattagtttgaatccttccactgttgtctggactccccattaaaaaagaacatgatcactgagaaagtgtctaatttagatgtgcttttgatagcaaaataattataatagacaaatccttgaaaaggaatttccttgtcacatgacactgatatactacaaaacagttgtgccatggcagcttataatatttaagtttcctgattctaggtacaaagatctctctgtgaaagctggccaaatattcaagaatgtactgaaatattcaaaaggtgtacatttatgatctagaataattgataagagttgaataattggattgcttcactagggaaaggcagaaaatgtatgactgtagagttaacattcttgagattattaaggaaatgataaagataacaatggagaattcctttcagtgtactaaaagttagggaagcagtggaggcttttgctgaaatttgaaagagacaaatattgaggcaagtgaaaagtaatagtcgagtcatttgagatatgtgcattttactctgtcagttttattttatttttaattaattttttaaaatttcagtagcttgaggggtacaagtcgtgctgggttatgtggatgatcgtacagtggtcaagttttggcttttagtgtgcccaacaccaaaatagtgaacattgtattcaataggtaatttttcatccctcacctccctcctgaacttctttcctctgagtctctaatgttcattatactactatgtctgcctttgtgtacccatagcttagctcccatttataagtgagaatgtgcagtattggttttccattcttgagttacttcacttaggataatggcctccagttctactcaagttgcggcaaaagacattattccactcatttttatggctgagtagttttccataatgtttccgtggactcatttgtcagtacccaaatcagtagcattgctgtgcaccaacaatgaccaagctgataatcaaagaactcaatcccttttacaatcgctacaaaaataaactaaaatacctagggacatacttgaccaaggaggtgagggatctctacaagaagaactacaaaacactgatgaaagaaatcatagactattcctttccatggaatgataaggaaatggtatttccattttatttatccacttatctattgataggcacttggattggttctatatctttgcaattgtgaattaggctgtgataaaaatacacgtgcaagtgtctttttggtataatgactatttttcctttgggtagatatttggtagtgagattgctggatcaaatggtagttctacttttagttctttgagaaatctccatactgttttctatagatgtttcactaacttatatttccaccagcagtaggtaagtgttccctttctacgacatctgcaccaacatttactgttttttaatttaaattttttttttcataatgaccattctggctggagtaaggtggtatcttgttgtggttttaatttgcatttccctgatgattagtgatgttgaacattttttttctgtgtttcttggccatttgtataacttcttttgagaaatatctgttcatatgattatctcaatagactcttctgagtctattcaataaaattcaataaaatccaacatctctttatgataaaaaccctcaacctggtcaggcgtggtggctcacacctgtaatcccagcactttgggaggccagcgtgggtggatcacttgaggtcaggagtttgagactagcctggccaacatagtgaaacgctatctctatttaaaaaaatataaaaattagccaggcctggttgggggggagcctgtaatcccagctactcgggaggctgaggtaggagaattgcttggacccaggaaacgaggttgcagtgagctgagatcatgccactgcactccatccttagtgacaaagcaagactgcctcaaaacaaaaagaaaagaaaagaaagaaaagaaacaaacaaccgtcaaccaactaggtatagaagaaacatacctcaaagtaataaaaaccacatatgacaaaggcacagccaatataatactgaatggggaaaagttgaaagcattcctcttaagaactggactaagacaaggatgctctctttccctacttctattcaacacagtactggaagtcctagacagagcaatcatgcaagagaaggaaataaaggacatccatattggaaaagaggaaattaaactatctctgtttgccagtgatatgatcttgtacccagaaaaccctaaagattcccccaaaacactcccggatttgatcagtgaattcagtaaaggctcgggttacaaaatctatgtgaagaaatcagtagcgctgctatgatacaatgaccaaactgagaataaaatcaagaactcaaccgcttttataataactggaaaaaaatgaaatacctaggaatatgcttaactaaggaggtgaatgatctccacaaggaaaactacaaaacgctgatgaaagctgacacaaacaaatggacaaacagacaacacaaacaatgggaaaagcatcccatgctcatgcattggaagaatcaatattgtgaaaatggccatactgtccaaagcaatctactttggacaaagattcagtgtgattcttatcaaaatgccaatgccatttttcacagaattagaaaaaacaagcctaaaattcataagaaaccaaaaaaaaaaaaaaaaaaaggaagaaaagaaaagaaaaaagagcctaaatagccaaagcaattccaagaaaaagagcaaagctggaggcatcacattaactcatttccaattgtactaccagactatagtaaccaaaatagcatagtactggtataaaagtagacacgaagaccaatgaagcagaatagagaacccagacataaagccagatacttacaaccaattaattttcaacaaagcagacaaaaatatccactggggaaaggacaccctattcaatacttggttctgggaacactggatagccacaggtggaagaacaaaactagatccctatctctcaccatattcacattaacccaagatggattaaagacgtaaacctaagacctgaaaccttacaaattctagaataaaacctaggagaaacttttctggacattggcctaggcaaagaatttatgcctgagaccccaaaagcaaatgcaacaaaaataaacataagtaaatgggacctaattaactaaaaaacttctgcacagcaaaagaaataatcaaaagagtaaacagacaacctacagaatgggagaaaacgtttgcaaactatacatccaacaaaggactaatatctagaatctacaaggaattcaaacaaataaacaaggaaaagaggccaaataattttattaaaagcaggcaagtgatatgtaaattgtatttttaaaattataacaaaagagtgaaatctagtaaatgttatacctcttggtgtttaggagtgaagtgtactgaggtcttgaaatgcatccaaaattataagttagctttcaatgttcaagttaccttgaaatgtgtccaaaattaagatggattaattgacgggtggattaatggatgatagaggtatacatatgtggataaataggcaggtggatatgtgattaagcaaatataacaaaatattgattctagaatctaacactaggaacatggctgttcactgtgcacttctctcaactttcctttatatttgaacattttcataatgaaatgttctttaaaaaaggaaagctacctgagacaaggtgagaaaattcttaatgcctattcaggtaatactagctgaaaaattgaaaataaactttaagtggagatgattgtcttaatcccaaagtattgctgacacgggatttgttagcatgtctctaaggtgatgcaccatatattttggggaaaagcatttcattttccctgtaaatcatggtgcatcaataatcatgcacttgcaacaagattgtctctgacttctctaacactctagcattgcttatgaaggacattcttctatttggccaacaaagaatatttctgtcttatcttaaaacagagataaggcaaatcattttgacagtctctgaggcaaggtaatccctgctaatctactcatctttctacctcttacatacaaagaatgggctagagtttgtcatgggaccacaggaatcaggctttgtccctgagtttattatttttctgaggcagggtctcgctctgttgcccaggctggagtgcaatagtgtgatcacagctcactgcagcctcgacctcctagactcaagagcttctttcatctaagcctccagggtagctgggattacaggtatgtgccgccatgcctggccaattttttattttttgtagagacagagatctccctgtgtttcccaggctgatcttgagctcctgtgctcaagcaattctcctgccttgacctcccaaagtgctcagattactggtgtgagccatggcatcccacctctgcttcattctaacataccacttcttccctgtttcccggactaaatactcaaggtcattaatagaacattattaaatttgaagacataaaaattctaactttaagctttactaaccaacataacatattgaattttccccaccacaaatttccaatagctggtaaattaatggtgtgttttgtctttcatctttaaatattgaatgaagcacagttctgctagatactcatatcacaatacatgtcttcagaaacaatttatatgcccagtgtatcaatatttaatttatttacacatttttttcatcactacctttatttgaatgatggatgtgttgatgcctaagcccatttatcactaagaatgaaataactaccactgggaaacttttgggaattatatatccatgagcttttcagaactgatcttttgtgacgatggaatggtcactgaccagatccttattgtagactcattacttttgaacacattcatcaataccaaggctcgggtggctgctggatgtcacagatccatagcactgtgccaccacgtgctccctaaaaatctattacatggtttagactatgttttcccaagcttaaacctaggaaaattgattgcctttcccataagtttacataatcagagaaacccagaactggaaagtattttaagcattcattcaggtcaaacatttgtgttctaatagaactttcttaaaatatccaatacaggcaacagcaggtcttattctaaaatatttctggaaaaaaattattccatttagataatgccatgtatgtatccagtccttcactatgtgcagtggtaactagtctaattttaattactgctctttaagccagtattcacctaaacttcataggaatgaatcccttcagtaacatccttatagtagacttcatatatttgtaaagctacataactacatataaaaccaattatgttttttcctagtcatttttatttataatgcatagtctaaactcttttgattttattttagaacagcattatttaaactttcttgctaaatagtaccagagaagcctagaaactcaagaaaaactacttttgaaatattcttgggatctaaatttttgtctttaaaacatgccacataaccttttctcatgtctccatactgaatcaatgcttaccttaaaacaccatattttaacttatgcattagatagaacacttccacacatcaaatgttcaggtaaaatagattatctgtgaacagacttggaatttattctgctgcttgccaaatccttgccatgctgctgtttcctccaatgtggtatgtgtttaaatctggggagcatactctcagtacatcacaagtatagcctattattattgttgttgttattgatgatgctattggtttaccaaaaataatttcctgtgatactaagcacatggctatccaattgaaacacttaacttttactgaggatctgagcattgtcccatggcatattaggatgtgttactgctaaatacccttctgaagatggtgaccgaatccttgaaatgtgtctgttgtggcagtttgaaagacaagtgaacgccaaggtcaggctatcactcagtgaagccaactggctggctgcccacgtttctcataacatttcatttattttgatggattcaccaaggtatgagccctggcactcaggtttggggcacagaaactttgatgtttataagcacattaaatggttccatctctagggtacagattcacattaaccaagggcacaaagactagcaagtaagccacagtgccaaaggataaattgataaagaaaagaaaaatggccttgcagctggcaggatgcgggtcagtgcggtcaggcccttctgtccctgttggcaggtatttcagaaaagctaaatgaacatccagaagttgctgagtgagtgaacatgaaatcaggaaagaaaaaatcagttttatgattaaggtatttagtagtatgaaccgaatgtttccttatccattcatttcttcatagagactcacatatcatggaaatcagagtgggcaagagttgggagggcaatgatggtatttacaccttccaattgttgcacagcttctatagatgtattcagttaaccgtgacgtaggcagtgcctttctctgtagtctgggaacagttctttttcttatgattcaactctgagaaggcagtgctttctttttttcactattacaccatcatgtggtgtaggtgagcttctggaaagggaagaataaaagaaattatgttaactgttcagaaactgtgtgatttagtaacatagagcttcgttacagtaatgtaccctgtaagtggaaagacaggcagtatgggtattacgaaatgatttttttttaatggaagagaatgatggagaaagagacaaaggaaagttatgttagagtcataaaccctgcatgatcctgtaaaaattcatgcttgatccctgcagcctgaatcaacatggacatcagtaaatctctactcttgccgaagaaacaaactaaggctataaagaagtactttgtttttgatactcattgtcttccctgacagccaagtcaaaagatggagataaacaatgagcgattttctaacatgaaaaacaagacaagaaatatctttcttataaaggaatccactcagtctgttagtgtatatactttgccagtcattcctacctgattcaatgaatatttattgattaaagatctagtcttgtgaaagagacacttgaaactggacaaacagatgtagtttgttaagtgctaccagagggataagccaaatgccatgagcagactagggagggatgccttgggagcctcattgaatcattctgaagaagtttgaaaggcagtcatggtgtgggtgggcatgcatttaactagtaggttgacctaggagggaaatatgcttctgcttttagagattaatgaatgtatttatcaaatgtgtattgaaattctaatgcatatcaggcttcgttaacactatggatacactgagcaaaagaaatgagattcagctcacgtacacaagtaggtaaatttttgttttttgtttttgtttttttttggattagcttttgtaaatttacatctagaagtactggtattgttttgtactctctctttcttttgttttttgctttttggggggaaggggacttccaaaatggtattatgacttttcttctttgaaaaagagttcttaaatttatcttcaaaaatctcttgaaaactagaacaaaatgaaaaatgactaggactgcattgttaaccttatcaattgtgactatcaatatggaatccttacacctatgtagtttatgaaggcaaagcctacagttagtttgagacaactattaagcctgaccaaattctcagaatgcttttatgatgctaataagtatcactacaaaatgaattgatgtttctcatgcagccaaagtggcaatgattttacaggagggagaggcatgaggttggttatctcttcctggcagatgggctgtccctccccaacccctcctcccgacacagacacaggttggtaggattttttctacctacaggttggtaggattctctgggagaatgaaaatatttttaaaaagcaaaacaaaggaaaactcttaatttatatttaaattacccataatcgaatgattcacgcaaaatgaacttttagagcaaacgtcttttcaaattgtatgagggatggcttatttttaactaacggtactgacaggacattctggggactgctgcagatactggctgctctattcacaaagactagggggaagaaaaggctgtcttcagtaatgaatggaaacactgactggctttgaggcgagtaattgccttactcacccacacaaaaatttcagccagaaaagtcctcctttaagcagagcacaaatgatgtgaaatgcatacttgcacagatatagtataacttaccttgagtttatttaattattcctggtccatgggatttttgaaaaattgccagaatactacttttctgcagatataaataaaaggtccaaatgttgcttaacttcttttttcctgaattgcatagtatatatgtgttagaaatggctaataaccgtcacagagtagttgagaagttaaaacacacacaaattcttaatatttctaattaaaagcagcataggaatattgattactacagtggaaatgtaatgtgttctttctttcctttttaaatgcctatatggtacttattaacacttttaatggcaaaagcaataaaaataattaaaagcacatttagttcctgttctgcctcatttcattaatttctgcttttttttcttttggagaaaaagttgtaaaattgatgtcttagctgtagctgcctctttatgatattagatttctgtatgtaaagaaggtattagaaaaattttctcctgcactcaaggaatctttaaacttaaaataaaaagtgattataccttctattttcaaggcagaataaaaatgttttacaatgaatagaattcttgattttcaaagaagtttattacatttgattttgtcagagttaataagtgataataaataaatgtgtggaaaaataaacttttgaactagatcaaatgtgtttgtttctatttcagtattggctttgatgcctaagaaagcaaaatatttatctactgaaagagcttatgtctttgtggcccccagcttttcctctggtgagccttaggaaaaatggcacttgctctggaggcagggaggaaactccagatcagacccaggtttctggcttgggaggtggtggtggtggtgaaggaagtgcagttggttaagataaggagatgaggtgaattgccaaattttcacccagatgctcggcggcctctaaaggtcggtggtgttaccaggcgcaaattagtaatgctggctttgaacttaccttgaagctgcagtgccacttgttcttttcatgcagtcgtatttcgccaatggctttttactattttcttaacctatgtttggcatcttacctgactcctgggcaattacaacctttaaccactagaaaaggaagtacattaaacacaccttgttcatcttgaagagagagcaggggaatgggggtttcctcagcctgggatgactttcttctgcctttcagatctaagctctttctgacctggatcttatttaactgggaaacggccaggatagatttgatctttagcgtttctaacaaacatcatcagggatctctctttcctgaatcctatcacatttagcatcttgcaccacagtgctgagtatttttaaaaatataattttctcttttgttcttctgatgtttaatacattattcatcttcccaaatagattctcatttatctgggtgcaataagttcatctagagtccttccttacctactttccttcctttcttctttcatgcattccttcttccctccattagtaataggctgactctatactaagacttcaaaaatgtgcatgttctttaagagtttacagatgttctaaaactgactgtttcagaggaactactttccttgactcaataatagttaatcctcaagaacgattatgtatagtttttttaattcttcaactttgtgagatgtggttataaaacttaaattgatatagatgaaacagtttataaatagttttcacttgcattatttcttggaaagctcgtaaatactgtatgcaagtatcccctccattttctatgtgagcagcatgagcctgtattatatctacgaagtaaatgagtgggggtaggttttgtgacatgctggctgcatcagataatgctgcatggcataagctgggcacacactgctgttcctgttttatgcctaggaagatgaaagccttatcttaaatcataaaagtaattattaatgggcagcccaggtgggcagaccaggctgccaagtttactattttctatcgctctacaatgaatattccacattaggtatagattatctgttgtcaagagagttttatatcacactttgatataaaattaagtgtaaaaagctattgagaatcaatatttgacattctaaaagtaacttcaagatgataaagaataaatattatactaagcccaaaaatagtttctgggtttgttatattcatctgtttaataaatataagtggatgcgtggtgcaccaagaacttagcttggcattgaaaatgcaatgagaagtaactatgttctctactctccttgtggacaagagtctagtctgttaactagaaactacttctagatgattgggctgcaaatatgatccttctgctatgttttgcctagaactttaggcagaactttagttctaggcagaatgtagcagaagattatatatgcagcctgctcatcccctgaaatcaagcttaaagatgatggtctgccttgttagtaatccgtagaggcttatcaatcccagaaattttgggctattgttccagtctgtagatcactgacattcttttagtgctctttcaaccacaatttatagttcccaggatgggtcaacaactgtactcctgggatgtcttttctctctgtgtttgagatgcagatagctagttatccgccagtcctcacaatgctgaaatgcatccctcaagattaaagattctattcctaactttaaggaataaatctgagcttagtgcttcagtccaaatattttgtgaatacttagtatgtgctttactaggtgttatggatacagaaatgagtgtgaaatagtctctgacctggtagaactcaatttagacttaaacataatttggaaaataacacgtatggaggaagattcataagcctgatcatgtgtgttaggcataactagttaggcttataattatgcttaaatggattagatcaaccgtgtatgtaacagagctagtaaatagataattagatattaaaatgcaggtgtactgattccgaagccactaactcgtaatgcatctaccaaattcctctgagtgtaagattgttcattttagcagtttcagaactgtgtcactccaggacttaatctgtatggtaggggttctccaatttgagtgtgcacaggaatcatctggagagcttggtacaacaaagattgctcagtccttccctccccaggaactcactaggtctgagctggggatgaataatttgcatttatataaactcaggggtgaagctgaccatattttgagtagcactgaccttggggactgtttcccagacttcagcacatagtagagccatctggagagcctgttaaaagtggctgttaggacttccctggccctggagattcagaagggctgtgatggggctgaataatttttattttcaacaagctttcagatgatgctgatcctactggtccatggactgcactgagctaaggcattgtctaaataggtagacagaagtaacctactaagaaactcaattttgaaaaatatgaaggcttgatcaaaatatgtactctccttagcatggagtcctttcatcagagaaatgggaaaaagtaaaagtaggaaactaaatggcatgaatctcatgggcaattttaagaagcagtaggcactctaaatagcaactgactttgatatgtatggaggatgttttacatatattgggagaagattgtctgtctgaataatgtaactgtagaaagacccttagctttgtgtctatttagaggtcaatttcagtttctatccctctttttaaaaatatcttgtccgtgtattctgttcctaacattaacatataaggttgatagaaaatatggataatataaaaagtggtattgaatgatatcactagaaatagtgttcatgtaaagaaaagatatgggccagcaccaagttctgggcaactccacaattttgagaaattggaagagtggctggcaaataacaaacaggaaagtatggtgtcacaggagccaagaaaatgttctcgtgggaggcttcagcagtgaaaggattggaatgctgataagaaatactgtaagatgatggaagaattggctgtctaacttggctccatggagatcacgatatttctcattggaatgttttgctcaaccctaattgtccttctttgcagaatgaaagtcttgtgggaaaatagagattaaaatataactaattctgtctataaattatatagacatatataagaaatatataaattcaatctataaaatagaactaatgtgtttgtgtgcatgcaacatttttccgtgaaatatagttttgcttctgtatttttctgttcttattcatgccacacattattcattagcacagatttatattccattttgataactgatatccacagatattgttttcaaaattattattttatatgattatttttccatctaaattttaaaatcactttatcaattaagaaaaaagttttatttggattttcactggaattactttaaatttgcagattaatctaggaagaagggacatctttaccacattgaattttccttaacagggatttgaagattctctacatccttcaagtggtcctataaattctctaataacattttgtggttttccctctttgggcaataatactttctaaagacatttaatatattgttttgctattataaatgctgtttttatatgtttttattatagtactgttcattgacattaagtacatttgcgttgctgtgcaaccatcaccaccagccgtctctagaacttttttcatcttatcaaactgaaactgcataaccattaaaaagataacttcccattttttcctctcttcagcccctaacaactaccattctgccttctgtctctaagtatttgactactcgacgcacgtcgtttaagtggaatgatacagtatttgtccgtttgtgactggctttattccccttaacacagtgtttttaaagttcatctatgttgtagcaactgtcgggatttccttcattttcaaagctgcataatactcatacatacacacacaggcatacacacaacattttgttattcttttcatttaccaatgatcatctgggttgtttccaccttttggctattgtaaataatgcttctgtgaacagaggtgtacaaatatctgtttgcatcactgctttcaattgttttgggtatataaccagaagtggaattactattgattattaatgataatcctgttttactgttttgttagatatatcacaatatgaattcccagctacaattttggggtcattttaaatactctcagttttctcatgtaccattttcttgattttctttagtttgtcattacttttctttagctctcagagtgtatttaaggcagttgttttaaagtctttctctagtaaatctgaagccttgtttctttaaggttggtttccagagatttattttgatcttttgaaagggctggatttccctgtttctttatatgccttgtgatcttttgttgaaaattgggtgtctgaaaaatcagacacttcttccagtcactgtagactgtgtggaggaagatgttctctaaatagcccggtatgaaagtttaagattttctcaggcattttctaggtctgtgtcttccctgggcctgtgtgtgtggtgttctctcccaatttccccatagacggggctgcttttatttatttatttattttgaaggctgctttgaaatgttttattatccgtccctaagagtttcacccctgcttcttcgtgaaatcttggctgttcctctgtactactcttgccttaacaaacatcttgcccccagtttctgcatgtcagcatactcttgcagttttcacaaactatgttacccatcacagttttgcatggcttccaaactgagattcaaactatatattcattttcgtctgagagctccaattgaggcaagacagaaaccagtccctcaggcagcccacagacaggccagaactttgcaaaataagttccactgccctccttccttcctgagagaaaaatactggaaagtgggctacttttttttttttttttttttaactgcactcactgttccaaggtggcgcaagcacaagcaataatgccgtgaaatgtcctacctttttcactgtggctttttcttgatggggcattcacttggttggaaagcagtgaatttggctggttaccagagctcccaaaaagctgttttagtgagtcgctagtagtttacttgatgatcctgtggaggaatgaggacctggagctttctaatctgccatctttctgatatcaaatctgtttgtttgtattttgtcttttttagtagctttattgtagtttttaaccctaaatgtgtccagaatcacagttgcttagtcctgtcttagacctctaaatcgtgatgctaaaagtgtaaaactaacaccacacaatatattaaggatagctgtcatacttattttgtttctaatttactgttaattcatctaggagtgtgtatgagttcgttttgacattactataaataactatctgacactaggtaatttatgaagaaaagagtttaattgactcccagttccacaggcttaacaggaagtatgactggacggcctcagaaaacttaccatcatggtggaaggcaaaggggaagcaaatacatgttaccatggcggagcaggagagagagtgagtgaagggggaagtgccacacgcttttaaaccatcacgtcttgtgagaactcactcactatcatgagaagagcaagagggaaatctgccccccgtcatccaccaggccccttctccagttgatcccactaggccccttctccaccatgatattttggtagggccacaaatccaaaccatatccaagtgtgcaccaataatcgtaattattggggagtgataaatgtgaattgcaactcatataattgcgagttcttttataaacaaattaattgtaaaaaaacaaacccaagcttaggcaacatagcaagaccccatctctacacaaaatatatagaaaaaaagtagccaggtatagtggtacatttctgtggtcccagctacttgggaggctgaggtgggaggatcacatgagcccaggaggttgatactacagtgagccatgattgtgccagagcaggaccctatctcaaaaacaaaaacaagaaaaacaatcccggaacaaaataaataaaacaaacaaaaaagagcaacaaaagacacttgcttggcatttctaacaagcttccagctgatgttgatgcctttgtaccatagctcagattccagtatgatttagcatatttaaccttatgtaggtcaacagcataaacctataaagagtataattttgaaaaatgtgtaacttgtaataagttataaaaaaattactttactcagcatagagtcctctaatcatagaagaaggataaatgaggaaactgtgaatggcatgagagcaatgagcaattttaagaagcagtaggcggagtaagtattaagtgcaacttaaatataagaaataatctctatgattatattttctttattggtattcttaactgatgtcttgtaggaaaccatgactgtttctcctaatactagacaatagtccataatgtttgttatttatactaaactcttacattcaattgactaaagttgtctttagtataattacatttatttctttaaattgaatttgaattttctttttgtggtatttttttcagacatactattcagatgacacgaacttaataaaaatttagaatttttttctgccttcaatatgttataaaatattttaaatagtgcaaaagttatttgtttcttggaggcaaaaatcagattttgccttcttcttttggaaactccttgaaagttatctcagttccttttatgcttattaatctaatatagcttgtaaatgttgtcaattattttttccagaaggaaaagaaatgcacattttgtggacatttccaaatacctacatgtgtatttttatacacattctctacttttaaaaaaactcctctgattcctttttcattctagattttgtatagttacataatcccagcatatccagcaccttttttataggatgttgattgaatgtgcatagtgaatgttttatatcaatataagaaaattaataatttttttctttatttcccatagcaaaattttatgatttattcttttacctttattttttttaaccttgtattgtattattgcctagaaaattctttctcagactttatgctcactgggaacaggtcttattttaatttgtattcccagcttcatcttgtgtggtatcccaaaccttaacacactccagtacattttgttaaatggtaaatggtattatttaaggaaatttaaattgaatttctatatctcaaggcttttcaagccagagctggctaaacatttcttaggtgtgttgtaagagcatgtttctttaagatggagtttattccaggtatcttttaaagttttaactcttaaatgctgtttctttaatatcatgagacaatatagaaactcttaaaatattttaacttcctttaggatattttcggattattcagcataaatgtctttgaactatttcaaacctttccatatttgacattacttaccgttgaaaatataaacaccatcagtaaaataaaataactaaaagacagttcaaacttttgagctatttaacagaacgtgaactgatggaagaggagaccccattttttttttaattttgaggaactttattgaacttctttgagaaaacattaagattctatgtgaagatgtattgaagcaagtcaatatagggaagggataaaagaaagtgagtaaataagcttttgagtgattggtgtgattgggttaagaatgacgctaagaacgaacgtaaacagtgttcacactctagggctaaaaacccaagtacatcttttcacacggaaatacagatatttttaagaaccttccttgtgcttcttagaaagtagacaggtggttggagaaaatctatttttgttaaaacacacccacattcaatctagatgtataatttcaatatctcaatgatttttccttgtattttctctaaatgtcatgcttttcagactatttcaatatagatggattatatttcttttcagaatacatatggcagataaatacattgacgttttccaaaggaaagtacaaatggaatactatttcttaaaaaaacaaattttggtatcctttacttccttatgaagaaaagcaaatccgctggttaagattttttctttattttgccaaataaaatggtgtattacccttgcatttttcctacttattattcccagcatttttctccttgcacctaaacaaataaaaaatgaatttggacttagataaattatctttatagtggtaagccttgtctggtaaactaaactgttccctgaaggatgatgagtaatttgttgctggtagatgtaatgtaaatagttaggttacagactcagtttagtttggactatagcactaacgtgtctctaggcaatcacaatgtttaatatgatctgacgttgaacacaagcgtttcaactgatgcatccatccaccggggggctcatttacaaaagtagcaccatctatggatcatttaatgtttgcccctaagtttctagaccccctccttgtgatatcataatctaacatgcactttgttctgtgaccaaagcatccagatgaccatgttgcaagttcctaacatgttccttgtctaaggctgctgcccaggatcatacctgttctgttggtctggcatgtgcaattgattgctttcagatgttgggtggtagaaagccatcaaaaacaaagtcaatcaggatcactttcaccaccacttaattaactggctaattactttctaagcacctattaagagaacaagagattgttaactgacgtaaggaatctaaaattgtctaaggctgggtgtagtggcttatggttttaatcccagagctttgggagactgacacaggaggattgcttgaggccaggagtttgagatcagcctgggcaacatagaagacctcgtctttacaaaaaataattttaaaaaattaactgtgtgtgatggcactatgcctgtcatcctagctactcagaaggcataggcaggaagatgacttgagcccaggagtttgaggtttcagtgagctatgattgtgccatgggactccagcctgggtgacagagcaagaccctctctctaacaacatttttttaaattaaaaaaaaaataaaattttctaagatgtgattcttacattaaggagttaataactttaaacccaacagggatatgagggatctttatacatggttttaagcaacaccaacactaccattcaccatcatcattatgacgatgatgatgtcattcattcatgacataatgaatgatgagaaagagtacaagtatattgagggagaacattccaaacagttcacttagtgtaaactttcttatcatatacttaggtaagagttttttttatgagttattttattttaatccttccaacatttaaaaataattgtcattattattccagttgttcaggtaaaaattttgaggctcagaataatttagaagtgtgtttgcagtctcctagctctcaagtagcggagttggattcaaacttactggtacagtgtattttaggcacttttctttccagagaaaggaaagtcatatctggcttgcataactaggagaaattcccaagagaagagacatttgagcaggatgttgaatgactgacagtgtctataactggatgcatatgaaaggggttggatggaacagaattaggaatggaatggtgatgtgaaggttgaagcatctgaggcaaacgtaaggaaatggtaatcagagcagcatgaaatacaagattctttctcaaaagcagattgtgctggctggggaaacgggagcgtggatacagataattattcttctagactgacacatttgtgtttgattctttagccagtgtagggatgttaaagaactttggagaaaaaaagtaacgtaagtaacaccatgctttagaaatgtaatggtaatagaatataaggtggatggaaaggggagaattatattacattcattaagtcagcagttctcaaatagggacttgtatatgccttgagcattgatgagtcatttcagaggaaccacacattcttatgtgcatcactttatgaacagaaaaatatgtctcgctcaaatttgttttaccactttttaaatggtggacttccgtagccagctgtgacttggaaaatatacatttatttgcaaacattactgacttcaggatagcattactgaattccacatattactgtgaattttcccaaataaaaagtattgatgtacagttatgtatgggtccaaataacttattgatttattgattctttaatgtacttgttctagaaatatttatctttacaagtggcattatagtggttaagtgtgatctttataatcagattttatgaactagaactccagctctcctacttattagtgataaaaggatatgttactaatctcttcaaatcccgttttcttatctgcaaatttgtgaagatgacactaatcttaccagattattttgaggattatgtgagattgcaaatctaaaatatttcaataccagacacataataatatatataagctattattactctttgttagactatgtctggtagacattacatggttttatcatattcacaaactgaaaaacacagtcaaaagtcatttctcaaatggtttgtcatgagttggagtgacagcatatcaagatcataatcagtaaatttcagtttataattttttcttgattctcttactgaattgaaaagtcagttataattgctacatttctattctttttcctgttcttacattgtgaaacaataatatgtgcttgcttctgttagagttaataaataggaaagtatttatggttcttggcccagatacccattcgctgttggttactgccctttttttcactgtctcagttcttgagatgagtatttcccaactttcagaccactgtaggttttgatttacagcagcagcctctctcgttctgtcactctaccttctgagtagccttgaagtagggcatcattatagagaatcagcaatcatcacagcacacacattctaacaaagaaactcacctagaaacttgcaggaacgttgcattccagataagggtttatggtcacaaggcaactattgactgtctttatatcacttctctaaagctgataatttgggggacccactgtattgatttacgtggaaaatatgaatgagaatcctaaagtgcaagaggaatagaagtgttggataataagcattatttgaaaaagaggtgtggagcaagtcatttaagaaaaagtggaattgatctctcctggatttggtttatcagaatgaaagactaacttagagcgatttatctgagaagggaaacaacaaacaacaaaatgcctcctatgcatggtttcttcttgtatttatttagagtctagttctttaaatctgccgggtttatggcacaattcaataccaaaataactatatgaatattgacatcaatgttttaatctgtgagtcacaggaactcatgtacaaatttattaaatgttttctattctgtttatatttgttgacaacaaagcggctctacggcttctggtgtgatttgtgcacatgtagtgagctggatatcttcatattttgtttcatttatcaccaaatctgttagctatttctaaataaagaggctgtattgagaaaggatgaaaagcagttgggaaatggagtaggaagaaaaaaatgagaagctcagtgttttataaactgtattgcaaaaaaagctgactttcatttcaaatcattgtggtctgtgctttgctttggtgaattatgcccacacatatctagtcaacacaggagagcacagatcattggaggaatgaatagctttaccacatgcatcgtgagagatgtacaagtttattttccccatcaaccatacctttttccaatatcatgcatgttgcccagcaagacagtgtcattaaccactggtatagaaggactcatttaatttagttaactaaatcctgttttttttttttttttttttttatgagtggtgggagaactgtttaaaaaagacctgtttggttaacaaatgtgcgctgctctgcagtgagggacattttgaatgattttcccatttctagtctttgccccatccagttagaaagtagcccgtagtgcttcaagaacatttacatttacatctttattgtaggttccattgtagcaagaatacatgtaaatggactcgctctatttcaataattattttgcagagtattttggctatcatcctggtgtttatagtcaatgcatttttacaccatctacattttggacagcaagcataaaacgctgctggtttatctcacagagagagcagattgtcccccaaaagatagccatttataatatgtgcacttttgaataattaaatgaactactgaagaggaaatggattctaatcagctttcaaactgtgattgtgccatgcactgaatcattcctttatgaatacatttctcttggagcatgaataattacaaaacttttttttctatctcggtaggaactgggaagtaacagccctccacagagaaactggaagggaattgctattgctctgctggtgattttagttgtatgctcactcatcactatgtcagtcatcctcttaaccccaggtaatctgtctttattcctctcttatgatggatggtattgtggatgataatttcgcattcaaatgccttaagagggtagcaatatgtggtatcttagggcacattagcatgggttggaatttggaaaaaaagcataatcagacattttgcaaatggcacagtaattctgcagttcaaatatcatgcaggatattttggggaagctgaaaatgtaaaatatgtaagttgagaatgccaaggagatttttggtctccattgccacttacagacttactatgtgttagtttgataaatgcagaagacatttgacttttattgtgggttgaagatgagggagtggcatctggaagtttctatatatagatgataacccaactgtatggaaatggaaagacaggatttgatggaaaaagatcagatcgaaagagagtgatctaagcctctaaatttggacacctatttcttgtgtcttcttttcctttctttcctaaagtttttacattctaagtttctaccctatctaaagaaactttgcaaattgcccctgcaatgatttttggactgtgttcttcagattaaagagtttaatactaatatggaaattatcattgtgcttctttctggggactatttcaatacccaggagattcattactctttagtaggtactaataaggaaggcagagataaagggatcacttttaaactccttcagttgtcttccagatacatttagcagttgctgcaacccacccacccaactgtttttctcaaagaccaaacacccacatatgacacagtgttatgaaaaatagtcatttctgggataggattgaatgaatccaaaaatcaactgatatttttaaattatagcctgttgttgaatgctatttatttccacttcaggtttgtcttagttttgttattttatgagccccttaaacacattgaacttatttcctgatgtacaaaatatgattaacaataactgtttttcagagtcatttagtcaaataattttggtgactaattatacaaatggcagtatcaattgttccagtgagacacttcgtgagatataccatctttgaaaaatactgacattgaaataaataaactgccaaaaatgcagtttttagatgttagttaacatgtggagaggttgagaaagaaattaagggagctactagggaggaaggaggagagaaaggtaattggaaaggaagaaagaaaaaattccctggtaaaagttggcttatccggcattctccccaggaaccttttcttaactgcctcatttgtacatctgcagtacaatgtcattgagcaatgtgatggctctaagttgctgcataatgccaagaatcattgttacaggaagatgagtttcagcatggtgtttcacttaaacacaagaagtttaacataattataaaaaaagaatgagtcgacattgctgccttctattgatggctattagccagatggaggtattcatgtcataatccctgtgtatttctcttgaactctttttctttcatcctggttctagcatccttggcccagtgattcactttctcaggttttcttgttactcattgaggccatagtgatattttggtgtccttgagagtttgatacaacaaagaccacatagagtgaggcactcactaagttaaacttctgctcaacccttttcaatttttcccagtataaaaccacagtgatgaaccataattgagttcattttgtcctgcacttattcatttgttaaagcaagaacaagcgtgacatacctgagtttgagttctgcctctgtaatacagtagttttgtgcaatttggcaagttatttaaccttctctctcactttactcatctgcatgatgggtataatatttagttccaacattgcagtgttattatggaggtaaaatgagataatgtagttcaagagtttatttagcatgctgcctagcactgctgctgctattcctttgatgattgctattattcagtacttattgaccaccagaaaccatgacaagcagtgttatataaagaatgttccccagaaaaggtataaaacctctcaggaatatacatcttctgtgacttcaattttagttatgacaaacggaaagggacaaaatatttaacctgaagttagtctcctggggtcaaattattcatgcattcattcatcccataggtaattgtggagttctcaccacattctaggtgctgttgtagttggccctgcactttcgctattttataactttcacctccaatcccgttacacaaatacaaacatttagaaaatacacatatttagaacaccacagccccccaactcagacttaatttcatatgatattaatcatataaatagaagtggcatttatttatttatttatgttttgttttaagatggggtctcgctctgttgctcaggctggactgcagtggtgcaatcatggctcactgcagtcttgaacttccgggctcaagcgatcctcccacctcagcctcctgagtagctgggaccaccatgcctggttatgttttattcttattgttatagagatagggtctctctgtgttgtccaggctggtctcgaactcctggtctcaagcagttctcttgcctaggcctcccaaagtgctgggattacaatcataagccaccacacccagcccacaattattatttagatttacagtttaccaagtgcatttcacatactacatgttcaaatgtctttggatttcactattattattggtagggacattataaaataaaaaagaaaataataatgctggagtggaaaaggtattgctgtaggaagcagacaccctactttatacagagagtgttctatactttctgcaaactcaatgccctcaagtgcctagaagattatgtaaattgatcaagtgggcaagtataacaactagtggttagaaatttgagttgtgacccagcaaaatggcagtgtagtcgcatggcctttacggtgggctcaacccaaacatgtcagagtaatacataaggccagaagactaatagtttgcagctcaagacttgagtcttcagcctggaagaacttttagaaatgatctagtcttgcctctctcatcagacaggaagaatatctgagtttgtttaacttttggggtgagaacaagaatatccatcaaggccatgtacactcttgattttgcgtgtgtctggctgtgtacgtctgtggtcagcctgcagtgctccaactgcaccaagcctttctcttctaaccctcaggcttgagttctctcagctgtgctaaaacagagccataaagaaaacctccagctggaaattaaacatgcagcatcatccctctgatcttccctctgtccaccaatatgttctcaaggcctagctttctaagtaaaaccagtcaagcaggtggaaactttcaaccaagtagaggaatctatgtcaggaggggaagcttctgactgtggaaattcagcaagacactgggccttttaggacaaggcctgcctctagaacaactcttccaataagagtggcagtcaggccggacgcgatggctcacacctataatcccagcactttgggaggccgaggtgggaggatcacgaggtctggagttcgagaccatcctggccaacatggtgaaaccccatatctactaaaaatacaaaaaatgagccgggcatggtggcatgcacctgtagtcccagctactcgggaggctgaggcaggagaattgcttgaacctgggagtcagaggttgcagtgagcccagatcgcaccactgcacttcagcctggtgacagaacgagactctgtctcaaaaaataaaaaagagtggcagtcataaattcatatagcttttataattatacaaccctgggctagtcactaacttctatggcttcagtgtttcattgaagaaaaggacatctttggtttgctaaaatgtgaggtgatctcttgaagtgtattataactctaatgtctattatctaatatattaataacagctaccaatgataataatgccttgtttagtgacaaatatagcaacagatgaaatatggtgggctctttcactaagatttttctaccatgaaaatatatttagtgggttggttttgaagatgaaagcatacaaaaagttatttagtcaaagaaatgttttagaaactgttttactcaaaatagcacacaatttgcaggtaagtctaaggaatgcaagcctataaccagagaaacacatgttcactgtaatttcggtttgattgcaaattttattacagaagtagtttgacacatgtgccttaatttctaaaattatcagactcttccttgccttgtgaagagaagtcctaactatttttgaagaataggctattcaagcatttcattttataagtatttctgaaaggaacaaattattcattccatttttttaattacagggtggacttattcagatgcattgatgaagcctacattattttttctattgagtttgtttaaagagaaggagtttacccacgtttattttgagaatatgttaactataagatcaataattatactctacaaatatatgagtgtacattaatgcttaaagttgtagaaatcagtctagtaaaggtatgcatctactttgcaatcttgtttttacatttaatatgtagaatgagaaggaatatacttgggagaacattttgtgcagaatagaattaccaattttggcctgttttaagaacaaaggtgcatattttatgagtcagaatgcagttgatacaggatagtcatcaggctctttaatccatctgccatactgaaatagccacctgcgaactgtgtatactccacagttcttcagcaacaatggcctgttgccctttgactgtgtctgtaatcggtcaatgccgagacagagtcatcacactgattatctgtcatgctgactaagggtaaaacgggaaagcaccaaaatgtggtcttcattgttagctctagctcctgtttcttttggaaacttcccaattaccctctgttacaatagtgggattcattcctttagtacactttttaggtgtgcacagtagatggtctttgcaggtttatcagaatataaacataaccaagcattgatgtgggaatcatgagagctctgcttgatctcagttaaacaagaatttaatggtaatttttcagttccgcaatagagatgtctttattttcacttctagaagtgtctctaagattaagaattttaaactaatttcataggccatgttgggtaataacttacccaggtcgatactgccacagtgatgttgatgattagataagtctttaatatcagatatgtgttacatccatgaagctatgctcaattagttcatttgagtcaaaacagagaattaagcaagtgaaggaaactagagaaacataggcagccctattcagaaaaatcaacaaaagaaaccaaaaactagaagacagcatttaaggtattatgccttttttacatcaacctaaatgtacagtgcacacaatcaactcatttaaccctcataacacaccagtttaaaggaagtagagcagttttctacataacacagctagggccaatagatttggatgacttcagcagctagtttgtggagaaagtatagtagatagagtgactaaattgaccttggtattcgactgacttggattcatctcctagccttactatgtgcccacaaatatgatgttgaggtaaagaatcctctctgttcctattgttaagacaacagattaaaaaaaaaagatttgaccctttgaaagagggctttaaaaatattcatatgcctgcacacacacacatgcacacacacacatacacacacacacacacacatacatctatatgtaaaactcatttcctagaaagcatttaataaaattaaggactttattggactgatgacagctgatctgttattgttatgcaaaaactcaaagtgaattcattctagttactattttgctctaacaaaatgacagctcctggttatagttagttaaaatgttatgttgtactatattgcagacaatatcttggcatctgtaatttattaggtgtcatttaagcacctgacctgtgttttaaaatgtcaaagcaatgattaaactatccccattatgcattatgaggggaaaataatgttttaccagatttttagatttgtactacttgtaaacatcggcatcaatcaagatgcaaattgtttattttgttgaattaaagcaggagatgtgctgtattgataggcatagtctaatgtgtctctgcttgtttttttcaacaacagcacagattgaacatggatttccatgtagcattacccaggcataatcaggctgcagagaaaacaatgacagattctaacagtttccccctggataatatggattgttgttgcttttttaaatagatttatctctgatgttgaataaaaaataatttcctctggcattaacggaataaaaacagttacttttttgtctttcctttatagtttcatttctatatttaagccatatgtgattcccttagttactctcataatgttagagtgtccagtcagataaatgatgaatttggtttacattataatgtgtttagttttacaagagtcagaagagaacctataaacatttatgtatatctttttcttgccagatgttgtactaagtgctttacatgtactattttttctcacatcactaatattgcatagatactattcatttatttacattctagagtattcatctgagtcttacaagttgaagtaaattgactaatttcacacaactagaaggcagagatgctcgatcactctctcaggcacttttagctttgacatgtgtcataatccttgtaatataagttaagacatattcttgtgcccatggatgataggggcaaaaaaatattttagaaaaataaatttcccctttattctttcctatgatttttgtaattagtaaactaattctatgtatttctaaaagggaaggcatagcagagaaagaattcagctgaggattgaggtgtaaaaatttggacaaggggcagaaagggaggcagtgacagaagtgggaagttgaaaatcgtaagtgtaaattctgtatgtatttttatttctggtttcataatttttcagaacttcaaatacccatgataaaatataagttcatattttccatcctaaaccacattatataaaattgtgtgtcattatacaactttaatagtttgtcatatattttatttcttcttcctaatagaaatttgatttagaaatgtgatattctggcctctaatgtatgattagatagtctggtctctgagaagtcaggtttccataaaagcgagagttatggtggggtttggtggctcatgcctgtaatcccagcacttgaggaggccaaggcaggaggatcacttgagcctaggaattcaaaaccatcctgggccacatagtgagaccccatcgcaactaaaagttttttaaaacaattagccaggtttgttggcacatgctactcaggaggcaggaggattgcttgagacggagaagttgaggctgtagtgagccatgatcatgccactgcactccaagctgggcaagagagcatgactctgtccaaaacagtcttccatctagttccaaaacatattcatcaccccaaaaggaaactctacccattaagcagttgctcctcatatcccacctcagttgctcctcatatcccacctccctcatcccctggcaatcaccaatctacttctgttctctgaagatctactttttctagatatttcacataaatggaatcaaataacatgtgacctttagtgtctaacatctttcactttgcatgttttagaagttcatccaccaagtcacttgtaacagtgcttcatccctttttatggctcatagcaatccattgtatgcatattccagagattgtgctactgtgaacctgtgtgtatttgtttgagtccatgtttttagtgtttggggttatatacctaggaatggaattgctagatcctatggtaatttctgtgtttaaatgtctgaagaactatttgccacagcagctgaaccatcttacattcccaacagaaatattcatgtgttccagtttctccaaattcttagaaacacttgttcttttcttttttttttttttcaattatgggcattcaagagatatgaagtagtatctcatttggttttaatttgcatttccctaataattaactatgttgactgagtatcttcttatgtgtctattggccatttatatatcttctttaaagatagatctatttaagcctgttgcccattttaagggacttgctggttttactgatagtgagttgtaggagttctttattccggatattaatctcttgtcagaaacatattttcatatactttcttctataatgtaggttgtctctttactttcataatagtttcatttggtgcacaaagttcttcattcacctgttctttcattgcttgtgcttctgatgtcttatttaagaatacactgctgaatccaaggtcacaaagatctgtcttttgttttttttaaatgagtttatggttttagtttatctacatgggtcattgattcattttgagttaattttttttatggtgtgagttagggagtctagctttaatttttgcatgtgaataaccatttcacccagcaccatttattgaagagaccattctttcccaattattattgtgtgaaccttccttggttatagatatatgagttatttctgggcttataattttacttcattcatctctatatctgtcctcatgctggtactgcattgtttggattactgcacctttgtggaatgtttgaaatctggaagtgtgactattacactttaaaaatatatatattgctttgctatgaagagcccatcacagttccatataaatttgagaattagcttttttatttctgcaagaaagccagttgggattttaatagtaattgcattgagtctgtatttgctttaggtaatattaccatcttagaaatattagtgttccaactcataaatatggaatgtcttttcattctggaaataatttaaataaaacaaaaatcaacattttgtagtttatagtgtaaaagtttttcatacttggttaaattcatttctatttagtttattcttctttatgatactgtaaatagaaccttaatattcttttctgattaatcattgttggtatacagaaacatgactgattgtttagtgttgaccttgtactcttcaactttgttgaaatcatctattagctttagtagcttattgtagattatctgagattttctatgtatgaggatcatgtcatgtgtgaacagagatagttttacttcttcatgtccaaattgaccatcttttagttctttttcttgtctagttactctggctagaatttccagtacaatgctggataacaatggtaaaagtggatattctcgtcttattccatcataggtggaaagctttcagtctttattcattgagtagtcttagcttgtttagataaagattctttacattgttgagggagattctttttatttctagctcttaaaatatttttataaggagtgttggatattgtcaaatagattttatcaataaattgagatgatcatttgttttcctcccttttctactatatgttgtattacattgattttcttttgctgagccactcttatattcctggaataaaacccacttgttcatgatgtataagcctcttcatatgctgaagaactcagttttctaatatacctgaaggatttttacatctgtatttataagagatattgatctgttggtttcttttcttgtgctatctttgtctaggtttcatatcaaaataatttttaacctcacagaatgagatagtaatcttttcttgtacagttttgggaggagtttgagaaagatgagtgttaattcttctaaatgttagaattcacaagtgaagtcatctggttctagcctttctattgttaggaaggtttttgattaatgattttgtaacttactcattataggtctgttcaggcattttatttcttcttgaataagtttggtagtttgcgtttttctagaaacttgtttacatcatataatgtcttagttcatttgtgctgctatagcaaaataccacagactgggtaatataaacaatagtaaattatttctcacagttctgcaagctggagaaagtccaagatcaaggttctagcaggactggtgtctggagagggctgctctctgcttccaagatgatacctttttgctgcactctccagagggaaggaacactgcattctcacatggcagaaggaacagaaggaaaagacagccttcccttcaatcctaagctcttttataagggtattaatttcattcgtaatggtagggccctaataattacctctcaaagttcacacttctcagtattattgctttggggattaaatttcaatatgaatttggaaggggaatataatcattcaaaccatagcatataatttgtatctgtattgtttgatacatatatgtttattattttgtctctttaatgaccatttttcaatatatagtatcacttcttctcataacaatttttgacttaaagtctaatttttctgatatgaggataacaaattctgctctttcttgattacagtttgcaaagaatatatttttccatcatttaccctcaatgcattgcatctttagaaagcaagtaagtgaattttaaaaatccattctgccattttcagccttttgaatggagaattacatttatttacatttaatttcttaaaatgaagtaattgtttcattgttccatttgttttctgtttgtccttttacgtgttttttttctttaagtccttcaatgctgctttcttttgtgtttatttttataatgcccttctttgatctcttctcatttcctctcgaattttttttcttatggttatgttggtcatcataattcatattttaaatttagaacaatttagtttgaactaattttatcttatgttcaatcacatacacaaactgtttttatacagcttcacccttacaatattgtttttgtcacaaattacatctatatatattgtgtgaccattaatctagatttataattattattatacatttttcttttaaatcatgttaatataagaaatataaagatgagtcacaagccaaatatacaataagactgccttttctatctacctagggagttatcattactagagttttttgtttcttcatatagcttcaaattattgcctatatttttccacttcatgctgaagcctccctttgacatttttggagggcagttctacttattgcaaactccctcagctttcctcagcttttgtttatcagggaatatcttggtttctccttcatttgagtgacgattttgctatatatagaatttttggttgaaagctctgttcttggctgggagcagtggttcacacctgtaatcccagcactttgggaggctgaggtgggaggatcacctgaggccaggagtttgagaccagcctggccaacatggcaaaaccctgtctctgctaaaaatacaaaaaattagctgggtctggtggtgggagcctgtaatccccgctccttgggagcctgaggcaggagaatcacttgaacccaggaggcagaggctgcagtgagctaaggtggcgccattgcactccagcctgggcaacaagagtgaaaccccatctcaaaagaaagaaagaaaggaagctcttttctttaaaaatgttgttccaccttcttcttgtctctatatttattgctgagaaatctcctgttaaacttattgagaatcccttatatatatcaagagggttttctttcgctgcttgcaggatcctatctttgttcttatcttctgcgtattttattataatgtgtctcagaatgcatttttttagtgttttttttttttttttgagtttgttgaacttcttgaacatatagttctatgtcctttgccaaatttggcaagttgttggccgtcatttgtttaaatactctttctgcccttttcctctctctcctcttgtgatttccattattttatgttgctatgtttgatgatgttttaaatgtgtcttaggctttgctcattttccttcactcttttttctttctgctttctgtaccagtaattttaattgatctattattattttcactggttctttcttctgcctgctcaaatctgctgttttattcttctactgagtttgtatgtaagttcttagacttttaagctccagaatttctgtgcatgtatgtgtttaatactttttatctctttattgatattttctacttttttcatacattgttattctggtttcctttagctctttattcatgatttccttcagctctgtgagcatatttaacacaattgatttaaagtcattctctattgagtaaaatgtctgtgcctccccagcagcagtttctattaacatctgtgaatggacttcactttcttatttctttggatgctttacaatttctgattgaaaagtgtacatcttgaatattacagtttggaactcttataatcaaatttttcttccttttctgggtgggcttttgtttcttgctgtaggctgtagctatttgtgttttctttggtagaatattttaaactatttttgaaaaatcactattattcaccatgtatgttctctgaagtctctgttctttaggttgtggttagctagggttttctgtttgattattctgttttccttaatattttggtttagaaatgttttcttgaatattaggaggcaaatgtggctatggtggggtgtggaggctaggagaaataaaaaacagagagggtaaaataccttttcaggttagctctgtgtttcacacttaaacacttagccagcccatttacaactctaccttaatctttacttcctgcctctcttattgtgataaacctggattccttattatagttgaagcccagcataaggtttatatctttaccacctacactgctttctactttattatatgattcataatagtttctattacaaactaagttctcaataaatgcaggcatgcattgtaatattgcaggtttagtttcagaacactgcagttaaacaactattccaataaagcaaatcatacaatttttttttggtttcccactgcatgtaaaagttatgtttatcgtatttgtagtttattaagtgtgcaatcgcattatgtattataaaaatgaacagaccttaaataaaaactgctttattgttaaaaaaattctatttgatgatctgagccttctgcaaatcataatctttttgtcagtagagggtctttccttgatgttgatgactgctaactgaacaagctagtggttgctgaaggtgggtgtggctgtgacagtttcttaaaataagagagaaataaagtttgccacattaactggcaattcctttcacaaaattttatccatagcatgcactgctgtttgagagcattttctccacaatagaccttctttcaaaatgggagtttcttctctcaaatcctacttctttatcaactaagtttatgtaatattcgaaatcctttgttgtcacgtcaacagtgtttacagcatgttagctaggagtagattccatgtcaagaaactgctcctttcacttcatccataagaaaaaactcctcgttcattcaagatttattttgagattgcagcagttcagtttcatcttcatgttccacttttaattcaaattctcttgctgcccctaccacatctgcagttatttcctgcactgaagtcttgaacctctcaaagttatcagtactgattggaatcagcttcttccaaactcctgttaatgttgatattttgaccttttcacataaatcacaaatgttcttaatggcatctagaaatgtgaattatttccagaagatttttaattcactttgcccagacccttcagaagaatcagtatctatggcagccttatcaaatgtaattcttaattaccaacattggaaaatcaaaattactccttgatccgtaggctgcagaatggatgttgtgttagcaggcatgaaaacaaccattaatattgatgtacatcttcatcagggctcttgggtaaccaggtgtattgtcaatgagcagtgatattttaaaaggaatatttttatgagtagtaagtctcagtagtggatttaaaatatttagtaaaccatgctgtatccaagtgttgtcagccaggctttgttgtttcatttataaagcacaagctgagtagctttagcatgattcttaagggccctagggttctgaggatagtaaatgagccttggcttccacagaatgtcaccagctgcattagcccctaataggagagtcagcctctcctttgaagctttgaaaccaggcattgacttttcctctctagctatgaaagtcctagatagatcaagaccatgctggctaacacgatgagaatccatctctactaaaaatacaaaaattaggcaggcagggtgtcacgtgcctatagtcccagctactcgggaggctgaggcaggagaatcacttgaacccaggaggtggaggttgcagtgagctgagatcgcaccattacactccagcctgggtgacagagcgacactccgtctcaaaaaaaggaaagttctagatagtatcttcttacaataaaaagctgttttgtctacattgaaaatctctcgtttagcatagccaccttcatcaacgatcctagctacatcttcttgataactggctgtagtttctacatgagcacttgctgcttcaccttgcactttgatattatggaaatagggtctttccttaaacctcatgaaccaatctctcttagtttcaaagttttcttctgtagccttctcatctctctcagccttcacagaattgaagagagttaggaccttactctagattaggctttggcttaagggaaaggtgtggctagtttgatcttctatccagaacacaaaaactttctttatatcaacaataagcctgttttgtttttctatcatttgtatgttcaatagattagcacttttaatttcccataagaactttttgtggctaactgttgggagcaagaggcttagctttcagcctacctaagcttttgatgtgccttcttcactaagcttaattgtttttagttttggatttaaagtgacagacatttgactcttcctttcgctggaatacttagaggctactgttgccctaatttcaatattgttatgtcttagggaataagggggcctgaagagagagagagagacaggggatcaattggttgatgtcacggttagaacacgcacaacattatgctcttatgtggtcatggttcatggctccccaagacaactacaatagtggcatcaaagatccctgatcacagatcaccgtaacagatataataataataaagtatgaaaaattgtgagaattaccgaagtttgacacagagacatgaagtgactgcatgctatcagaaaaatggtgtcaataggcttgcttgacaacaggctaccacaacccttcaagttgtaaaaaacaatgtctgcaaagtgtaattgagcaaagcacaataaaatgagtatgcttgtattgaccagtgacaaatttatctggttatccactcttgcaataaaaatgtcagagaattgtttagtgaaagttcttgataatgaagtaataaataataatacaatagaataaggttattaaagctgatgatattaccaaatagaaaagaaagtcaacatcttttgagacttgaataatatttattataaccctggcagtttgaaatgtggaaaaacataaacttgtaaaatacacaataaagtacgttcagtagaacttagtgtagtgtactctaacaaagtattgaggacccaaaaatgctttggggcatttgaattgcatatatcaccatttgtaaaattagacattgcaaataaattctgagatttcaaataaaatgtgtattaatttatttaagatgacaataataaaacaattacatataaatataaataacaaaatgaaaagttatgtttttcaaaacaaaaaaagcaaaataaatggtattgtttcacatttttacaaatgtatttaatgtctaactcagaggaagatggcagaattctcatatgtgctcctctgttaattcttttgcaatacattgttttggttgagatatatgcagaaattctgacctgataaagacacatagtcagaaatagaatatgtatgttaatagctatttcagatcattgtagaggttttttgctgttacttcctgaaaactagataagtgctagatgcttgaaggttaattgcagtgtaaaatctgaataatattttaatactctgctacattaaagtccattggtccatcttacatgttgaaagactcttacccacgtctacttctgtaatatgaattggtcatttgtaaaatattagttcattgagttatgcaggtcttccaaatgtcagtggagtttattatacagccatgcacattataatggcttttaggtcaatgacagacttcatatatattggtggtcccatttgattgtaattcagctgtaaagttcttatcccctagtgacacaaccgtagtaaggtcatagtagcatgattcattactctggtgtttttggtgatgctggcataagtaaacctactgtgttgcctgtcctgtaaaattatatcacatagaattacatatggtacataataataatgataatagactactacattactggattatgtatttaatatactacacttttattattttacagtgcattccttctacctattaaaacataagttaactgtataatagcctcacgaatgttcttcaggaggtattccagaagaaggcatggttatcataggagattttagccccatgcaccttatttaccctgaagaccttctagtggaataggatatgaaggtggaagacagtgatattgatgatactgaccctgtgtaggcctaggctaatatgtgtgtgtttatgtctttgttttttaaaaataaaaatattaaaatagacaaaggttatgcaataaggacataaagaaggaaaatatttgtgttcagttgtcaaatgtgtttttaagctaagtgttattagaaaagtgtcaatgatgaaaaacattgataaagtaaagcagttacaggaagctaaggttaatctactactaaagaaagaaaattttttaatgcatttaatgtagactgtgcagtgcttataaagtctacagtagtgtgcagtaatatcttaggcattcatattcactcaccactcacttactgactcactcagagtaacttccaatcctacaagctccattcttgaagtgccctatccaggtgtaccattctttttatcatttataatgttttttaactatatattttctatgtttagatacacaaatagttaccattatgtttcaattgcctgtgattttcagtgcactaacaggcagtacaggtttgcagcctagcagtaataggctgtatcttatagcatagatatgcagtagactttagcatctgggtttgtgtaagtacattctacgatgtctgcacaaccatgaagttgcctaatagcacattcctcagaacatatccctgtcatttagtgacatgtgattgtacagttgttaaaaatcatgatgaatttcactaatgatttcactaggaaaagctcactagagaattattgagaaatgatcaaacttaagatggagaatatcagttttctaaaattcattttcttgcttgaaggggctcgaatttttttgtttgtaacaaatacagccaattgtggattttgtgaagaaaaagtttacttcattttgaagaaaaacacctgtcagacacttaaatctgaataattgtagtttgttactcattccttccagtaaaaataatgttctatgagaaacaatgtggtgagtttagctcataactcaagcaactgaccatatgcttttccatgagataaccatcatatttcgtatgcactggtgttattttattttttgacatactgcaccacacagatattcaaaagatgttgagagtcaagatgtagtacaattaatattttttactacttctgaactgaaactgggtttatttttaaattgaggctatatggccataaagaatataatgacaattgtttgatgtcacagtgtcgacttatgaaagggtgcctggagttttatcaaccattgcttttgtatcacaagtgaaaatttcaacccattgacaaggacaataatgtcttcgtgttattatgaatacagttttgatttctgtgacccctgtcttcctgaagtccacaaccatacaccagaaacctctggtgtaggctaataaagacatgcaataaaaatttggtcatggtaatgtgatagaatcaagcaacatatgtgaaggaggaacttaaatatgactttatagagccataacactttagggtaaaaggaggacatcatttcagggtgtatgtgtgtacacatgtgtatgtatcacagtgtgtaaatgctcttctccaaatgtggaaagcttacatacatttctcatatttagattctttactcatattcaggagatgttaatttgaaaaaggtctcagaaagaggtttgagaatcattagcattttgaatgattgactaatttggctaattagaactatgagtaaatcctaaagctcttgacttatgtaatcaatggatgataagtttgaggtaaaatttaataatagtccttcagaacctaaaggtacatttcttatttgatgagcactttgagtcactgccaaaaatgaaagagcctagtataagatataccagaaatttgagaatcctaagagatgcaagctagtttgcagctcatcatgtgtgtttgtatgggttttgtgtgtgtgcaagcatgtatgtgtagagcttcaaataaaattctatacaaagaatcaaacatgccaaagcagcatttttctggttgaagaggtctaatcacataacctctgtccttccctcatctcttctctatcctgaaagagttcactagagtccttagaacactgctggatatagtgtgatttagtccaactcttggtctttgcaaatgcaaaaaatgatgcataaataaatggagtgatctaaccaaagagatacctgctagtgaagggttgaattaggactaaaatatgaccttctaactctgatcactgtttgtgaagcatcattgcccatccccttttgagaacagagaagcagaggttagatttattacagtatgctgggcactgcagggaaggtgaaggcattgtaggtggtaaacttcttgcagattatgcttttgttttatgtactcagtatgaatatcctaaatattatttctatatttgttgaaaaaagagcagagttttgtgagaaaacagaaagaagcagataataaattatatttcatttgtcagctgtcctcctcattctatttaatacaggcacagtttggtcttaatttagttacttaccctatgttgagttttaaaaatgtatttataattaaaatatggctttctgtatgaaagtcccattttggaaatatactcagataggaaagaacattcattggatgattgtctgacccaggaaacaaattaaattaaggagtatgtattattaggctttgtaagatacagggataatctgagtcaaaagtagttcttgctttctttattttttattttatttaagttctagggtacatgtgcaaaacgtgcgggtttgttacatatgtatacatgtgccatgttggtgtgctgcacccattaactcatcatttacattaggtatatctcctaatgctatccctccccgctccccctacccaatgacaggccctggtgtgtgatgttccccttcctgtgtccaagcgttttcattgttcaattcccacctatgagtgagaacatgaggtgtttggttttttgtctttgcgacagtttgctgagaatgatggtttccagcttcttccatgtccctacaaaggatatgaactcatccttttttatggctgcatagtattccatggtgtatatgtaccacattttcttaatccagtctatcattgatggacatttgggttggttccaagtctttgctattgtgaatagtgctgcagtaaacatatgtgtgcattgtgtctttatagcagcatgatttataatcctttgggtatgtacccagtaatgggatcactgggtcaaatggtatttctagttctagatccttgaggaatcgccacactgtctgccataatggttgaactagtttgcagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtcttttggctgcataaatgtcttcttttgagaagtgtctgttcatatcttttgcccactttttgttgggtttgtttttttcttgtaaatttgtttgagttcattgtagattctggatattagccctttgtcagatgagtagattgcaaaaattttctcccattctgtaggttgcctgttcactctgatggtagtttcttttgctgtgcagaagctctttagtttaattagatcccatttgtcaattgtggcttttgttgccattgcttttggtgttttagacatgaagtccttgcccatgcctatgtactgaatggtattgcctaggttttcttctagggtttttatggttttaactctaacatttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatgtgtggtactatttctgttctgttccattggtctatatctctgttttggtacgagtaccatgctgttttggttactgtagccttgtagtatagtttgaagtctggtagcatgatgcctccagctttgttcttttggcttaggattgtcttggcaatgtgggctcttttttggttccatatgaactttaaggtagttttttccaattctgtgaagaaagtcattggtaacttgatggggatggcattgaatctataaattaccttgggcagtatggccattttcacgatattgattcttcctatccatgggcatggaacgttcttccatttttttgtgtcctcttttatttcgttgagcagtggtttgtagttctccttgaagaggtccttcacatcccttgtaagttggattcctaggtattttattctctttgaagcaattgtgaatgggagttcactcatgatttggctctctgtctgttatttgtgtataagaatgcttgtgatttttgcacactgattttatatcctgagattttgctgaagttgcttatcagcttaaggagattttgggctgagacgatggggttttctaaatatacaatgatgtcatctgcaaacaaggacaatttgacttcctcttttcctaactgaataccctttatttcttcctcctgcctgattgccctggccagaacttccagcactatgttgaataggagtggtgaaagggggcatccccgtcttgtgccagttttcaaagggaatgctcccagtttttgcccattcagtatgatattggctgtgggtttgtcatagatagctcttattattttgagatatgtcccatcaataccgaatttattgagagtttttagcctgaagtgctgttgaattttgtcaaaggccttttctgcatctattgagataatcatatggtttttgtctttggttctatttatatgatggattatgtttgttgatttgcatatgttgaaccagtcttgcatcctagggatgaagcccacttgatcatggtggataagctttttgatgtgctgctggattcggtttgccagtattttattgaggatttttgcatcaatgttcatcagggatattggtctaaaattctcttttttttgttgtgtctctgccaggctttggtatcaggatgatgctggcctcataaagtgagttagggaggattctctctttttctgttgattggaatagtttcagagggaatggtaccagcttctccttgtacgtctggtagaattcagctgtgaatccatctggtcctggactttttttggttggtaagctattgattattgcctcaatttcagagcctcttattggtctattcagagattcaacttcttcctggtttagtcttgggagggtgtgtgtgtccaggaatttatccatttcttctagattttctagtttatttgcatagaggtgtttatagtattctctgatggtagtttgtatttctgtgggatcagtggtaatatcccctttatcattttttattgtgcgtattttattcttctctctttacttctttattagttttgctagtggtctatcaattttgttgatcttttcgaaaaaccagctcctggattcattgactttttgaagggttttttatatctctgtctccttcagttctgctctgatcttagttatttcttgccgtctgctagcttttgaatgtgtttgcttttgcttctctagttcttttaattgtgttgttagggtgtctattttagatctttccttctttctcttgtgggcatttagtgctatgaatttcccgctacacactgctttaaatgtgtcccagagattctggtatgttgtgtgtttgttctcattggtttcaaagaacatctttatttctgccttcattttgttatgtacccagtagtcattcaggagcaggttgttcagtttccatgtagttgagcagttttgagtgagtttcttaatcctgagttccagtttgattgcgctgtggtctgagagacagttttttataatttctgttcttttacatttgctgaggagagcattccttccaagtatgtggtcaattttggaatcggtgtggtgtggtgctgaaaaaatgtatattctgttgatttgggtggagagttctgtagatgtctattaggtccacttggtgcagtgctgcgttcaattcctggatgtcctttttaactttctgtctcgttgatctgcctaatgttgacagtggggtgttaaagtttcccattaatattgtgtgggagtctaagtctctttgtagatctctaaggacttgctttatgaatctgggtgctcgtgtattgggtgcatatatatttaggattgttagcttttcttgttgaattgatccctttaccattacgtaatggccttctttgtctcttttgatctttgttggtttaaagtctgttttatcagacactaggattacaacccctgcctgtttttgttttccatttgcttggtagatcttcctccatcccttcattttgagcctatgtgtgtctctgcatgtgagatgcgtctcctgaatacagtacactgatgtgtcttgtctctttatccaatttgccagtctgtgtcttttaattggagcatttggcccatttacatttaaggttaatattgttatgtgtgaatttgatcctgtcagtatgatgttagctggttattttgctcgttagttgatgcagtgtcttcctagcatcaatggtctttacaatttggcatgtttttgcagtggctggtactggttgttcctttccatgtttagtgcttccttcaggagctcttttagggcaggcctggtggtgacaaaatctctcagcatttgcttgtctgtaaaggattttatttctccttcacttatgaagcttggtttggctggatataaaattctgggttgaaaattcttttctttaggaatgttgaatattggcccccactctcttctggcttatagggtttctgccgagagatccgctgttagtctgatgggcttccctttgtggataacccgacctttctctctggctgcccttaacattttttccttcacttcaactttggtgtatctgacaattatgtgtcttagagttgctcttctcaaggtgagaagagaagtttagggaaaaaaagagtaaaaagaaacaaagaaagcctccaagaaatatgggactatgtgaaaagatcaaatctacctctgattggtgtacttgaaagtgacggggcgaatggaaccaagttggaaaacactctgcaggatattatccgggagaacttccccaacctagcaaggcaggctaacattcaaattcaggaaatacagagaatgccacacagatactcctcaggaagagcaactccaaaagtaattctaattagtagaatttatcaggaatggaccagagcagactctgttttttttttttttttaagaaacctagctatttctgcaacaagagattagaaagagtaagaaaaggcaaaagaaagatatatagaaggaaatccctagtatgccaagaagagcaaaggtgattccctggaactgtaaaacagatgtagtgtatttgacttttcctttttggcttttgcttgaatggatgaattaggcttcacaatactaagtgacaagctattaggttttcttcattaaagagcttgaactatagattattatttttccaatttatattttggaacttataaagtcaacatagttaaatacacttctgaaaagagacttttctgtgaattttacattttactatatttttccaataactataaagaagcaacttcatattgtgtttctaaaagtaaatctgagaatacacgtagaaacatttcggttgaagagaacaactatgaaagagatatttcaagagaatgaaaaatattttttgtttgtctgaaagtgaataatgtgaaggtgctttatagggccctgtatattttacattttaataataataaagacaatagctaaaagtaaatgagctccgtaatttgcttggtgatttctatataagtcttcttttatgtaaaacacaaaacaaaacataacccaaaaaatctatgcaaaatataccaggatatatctttttttttttttggttctactactgtattagttcattttcacgctgctgataaagatatacccgagactgggatatttacaaaagacgaggttttattggacttacagttctgtatggctggggaggcttcacaatcatggtggaagaaaaggaggagaaagtcacatcttacggggatggcaggaggcaaaaagaaaccttgtgcagggaaactgccatttttaaaaccgtgagatctcatgagactcattcagtaccatgagaacagtgaaggaaagacctgaccccatatttcagtcacctcccactgggttcttctcatgacatgtgggaattgtgggagttacaattgaaaatgagatttgggtagggacatagccaaaccatattaactactatacaaattaactatttaaatttatttttttaatgtacattaaaaactgtaaatttcttaaggaggaaagaagaaactgtttttcattttctaggtgataagttaggaaacattaagaaacaagcttgtgatcttatcctgatctcaaatgacataaatttagaccatatttcatctgctgcctaaagtttcagcatcctagggaaagaaaagaacagatattttaaaaagaaaataagaatagaatttatatttcatatgttaagtactaaaacaaaatcttaggatctgctgacaagttagagaatgcacaaagcaatggcagatattttgaaaaatctagaatttaatcttgactattgtgatttgcattctgtagtttcatctagctgtgcaaggaggggtagaagtgatgttatttcaatcagctagtcaataatatttaaaatggaaatgcattagaagactatcccatatgacactaaccatggaaaatgaagaatacgattaagagtaaatatttaaactacagccctgggaatggagatggtggtactgggaaaacccagctaagggagaatcacgtgagtagaaaggaaaatagcttgttcttcttgtgggaaattttaaataactacttgattagatttttctttctatttctgttttaataggaaattattttgaataggatttaaattaaggaaatatttctaaacctctgatatcaagaataaactagataaaactaacacaattattttcagcaaagaggaaccaagaacttaaagtcataaattagcttttcttcagttgaatgctgaagaactttctttttttttcatctaagattatgcagccaactcatttcaaaggccatttaaaagcaagattggatttttggaagaaagaacagaaatacccatagcagtctatgatcttaaaggaccaaatagagcacagaaaagaacatggcgtgaattattcaatttcagttctgttgccacattcatattgtcaaagctgaactttttacttaagattctacaataccttgtaactatttaaccaataaggattctgtttccaggtctctaaatacttgtgaattgttaaaccatatatttatttggatttttgtgtccctattcataattatagtatctgatagggttaacaaatatttacacttttaatagcaactattaaaatatagtaggttttcagactttcatacatgtgtactctctctctctctctctctctctgtctctctctctctctctatatatatatatataattgtgccttatattttgttacagaatcactagagatatattctcaagtaacttgctagtaaggagaacaacctatgagaggtgaatattaaattttagcaatattttctttacattagggactaagtattgattttagaatttctttctctaaagattaataaaaattaataatattttgaaagagtgtctcaaaatgatttacaatctaatatttttttctgagccaccttctcgttgttcagtgtgagtgattgagatgaatgattgatatccaggtttctctgtttgctaggtaaaaataaagagaaaattatttaaatgtatcaaatagtaagatttctctaggtgattctccctgggtctgattctaacataaattaagttcctgctaaattacgttgcaatgtgagtaataaatgtttgttgatgactgagttccgttgtaactataaattgcctgtaacaatgagcagagggtaagcttggaatttaagacatattgtagacaagtgtcttgaagaaagcaaaaaaaaaaaaaaaattcctacattttagtgaatgctgtgacatttctctctttgagaaaagaggatatgctattatcttcctgggcaagttgaggcagaatgggatgctaataagctccagaggggcttacactaaggagttggatttcagttggaagaagggttctagtggctaaaaggcaataagaatattcctaaaatatttttgtaagattgtatattgtcttgtgaaaagatgctattaatacattattaaagagaaaaggaaagaaaacttatttttgggagatagtatagcttaatgaagaaaacctaaagtcagagagatgcaggttcaagtttcagctctgccaattactagttacgtggtctttgtcaacattgccgagcctgtttctctgtgaaatgaggatactaatacccagtagggtttgggggacattcagaaaagagaggattggttgcaaggaatgaacatcccgaaggattacaatgagacagggggaggctgctcataaaaaaaaaaaaaaaaaaaaaaaaaagatagaggatagaagttagccttggaggctattaaaagagaagcttaattattcattatgtgtataaggaaggagtctttattctaggaatgaaaaattcaagagacctcagggtaggcagctaaggaaaatttaaggaaaggaacaaagaaagcaacacagaagaagaaaaaaacaaagaaatgaatgaagtatatagttttctcagtattgaataaagccaaatacattaattattaaattacataatatctccttctcattattgtttaaacagaagatttatttatagttatttgaattgctttgaagggttggttttagaataagttccaggggcaattggagttaaaaaatattattaaaattattaaactattccagagcacagaaaataaacacaacttcaaaaatattgaataaatgtattaatgtgccaagtgatcaatataatacagaatggaaaacaaaggactgtgtaactttgtctgttaacctagatgtaaacatttaaataaaagtttaacatattaatctaatagtataaaaataagaattcaacgtgcttggttggattttgttacagacatatcgggtggttgtaaacaggagattgtatttatgtaatttttatatcaatgtgttaaaggagaaaaatatgtttatataaaagagtctggaaagaaataatgattatttcataatggaaaaaaagcaatgtcactgacactatgatcattcaacatttttttaaaataaattaattttttttagttttagggattaggcctcactctcttgcccaggctggagtgaagtggcgcagtggcacagtcatagctcactctaaccttgaactaactcctcaactcaaatgatcctcctgcctcagcctcccaagcagctgggattatagacatgagccaccttgcccagctcagtatcatttttcacattcaagctaatgaaataattcaatagaattaaacaaatgcttttcaaaaatgaagttggaacaattagtcatccatagacacaaaacaaaataaaccagcagacaaacaaaacttcatattaagcctcatgccatgtgtgaagatatacaaaaagtaactcaaaatagagcagggaggaatatgtgaaataaaactataacattttttaggaaaaagccataggagaaagtttcaagaccaagaaataggtgaaacattgttagacttgacagcaaaagcacgattcataaaaggaaaaattgattacctggatctcataaatattgatacctttttctccacaaaacattttctaaagagggtgaaaagacaacttacagactggagggaaatatttgaaattcacgtatctgacaaagcatttgtatttagaatagacgaagaactcatcaaatgcagcattaaacaaacacaccaacgaaataattcagttagaaagtgggcgaatgacatgaacagatatttcactgaagactatatgggaatcataaataagcacattaaatgatgttcaacctcattagctactagagaaatgcaaattaaaccacaaggggatatcactacacgtatataagaatagccatttttttttaatgacatcaaatgctgccgaagatgcagagaaactggatcatttatacattgctggtgagaatgtaaaatggtaaaactactgtaaaaaagcatatggaatttttaaataaaactgtaatgtgtttacatttgacccagcaactgcatatttgggcatttatcttggagaaaagaaaatgtatgtttgtacaaaaatctataaaaaaatgtttatagtaactttatttttaatatccccaaaccagaaataacaataactcaaatgttcttcaatgagtgaagagttaaagaatggtctctcaataccctggaatattactcagccatcaaaagtgatagattatttatacattcaacaacttgaatggatctcaagggaattattctgagtgataaaagccagtccaaaagcttaggtatggtatgattgtgattatatagcattcttaaaattacaaaattttaaaaatggagaacagagtagtggttggttgccaagggattgggtgggggactgttaatgaaagagtggcagaagagatcctagtgatggaactgttcttgactgtggtgctggtcacctgtgatgcagttgcgtagaactaaacacgcaagaatgcacgtgaataaatgaatacatgtaaaactgcagaaatctgagtaaggttgatggagtatatcaatgtcagtttcttttcgtgatattattatgcaggatgttacttgtcattgagagaaactgaatgaagagtacacagactttctctgtaatatttcttgcaacttcatatgaatcttcaattacctgggaagcaaatgcatacatagtataattagttgcttaaaatttggaaaagaaagaaaaaagtaatatgtttacagatgctataatttaatatgtagaaaataaaaactcataattgaaatgtttaagaaaatgtgatatggtgtaatcattaatcttataggtataaaaataatttagaatgggaatgggaaatattctgttcacaataccaaactatatatactttgcactaaattcaattggaagggcaaaggacttatataaaaaatcaaagataaaatagtattaatgtacataaaatgaggatggaatatttctgaatgaaaagccttaatattgtgaaatgtttaaaattttccagttttcactgttgtgtgtatgtatattatatatagtgttattttaataaaatttctatttgagttgtaatatgattttaaagctcacatgaaagataccatgtttgaaaattaccaaattattattttaaaatttatttgaaaataagattatttggtgtggtggacttacagccttttttttaagttaacatcttcctaaaaaatgtaaatgaaatatgtggaactcattaggaacaaactaaatgtttttggaagacaaacagatgcatgcatataaaagaaatttatatatataatacagttaattttttaaatttaatagataaggatcatttaagtttgttagcataatttctctcactgaaataagtacatgcctacctcccacctttacctatgtaaatttattgtatcaaataagtcaatgtttatcaaatatagatgataaaatataattctctaaaaattgaagggatctgattagacaaaataatggtaaatttacgtgatagggaaatttaaaaattttgaaacttatctatatcaaacttttgttttattgagatacctcatagaataaatatatttctgaaaccctaataaaattagctcatctgattaaaatcccatacttttatgatggaagctgaattctggaattaagatattttttcgcttgtgaaacaaaaagcacttatccttttatcgcaaatgttcttcctccttctcctgcccctagtattcccttcctctgccttttgaaacatgtaatacccagggtttttttaatagtttttttttataatagattatttttcagagaaattttatattcacagcaaaattgagtgaaaggtacaggaatttcccatattctcttccccctgacccccctgtgcctgatacagaccatgcatagcttccccaattatcaacatcccgcaccagagtggcacaattgctatcactcatgaacctatattgacacatcattgtcacccaaggtctgtttggattcactttccagtggattgtgttgtatgggtttggacaagtaaataaagacatgtatccaccattgtagaatcatatggaataacttcaccaccctacaaattctctatgttcacctgctcattccttccctcgcaattcctagcaaccactgctatttttactgtctctatagttttgctttttcaaaatgtcatgtagttgagattatatactatgtagccttttcttactggcttctttcacttcataatatgcatttaagtttcctccatatcttttcatggcttgatagctcattttttttagcacagaataataactcattaaaaaaatgtatctatttagccattcacctattgaaggacatcttggttgcttccaaattttggcaattattaataaagctgctataaatgtttgtgtgtaggtttttctgtgttaatatgttttcacctccttttgggtaaatacaaaggagcctgattactggattgtatgataataatttgtttagttttataagaaaatgccagattattttccaaagtgactgtaccattttgcattcttacccaggaattagtgagagttggtcattttatgtttaagtgaggccttctctgattttttctgtgagacatttcctttcttcaaactcattaagcactctctatccttatactgacatctattatgtatgtatgtgtgtgtgtgtgtaatttgttttttgagacaaggtctcaccctgtcacccaggctggagtatagtggtgcagtggtgcgatctcagctcactgcagcctccgcctcctgtgttcaagcagttctcccacctcagcctcgcaagtagctgggacctcagacatgcaccaccactctaggctcattttttgttttatatattttggttgacacggagtttcaccatgttggctaggctggcctggagctcctgtcctcaagtgatccacccgccttggcctcgcaaagtgctgggattacaggcatgccccactgcgcctggcctgacatctattatatgttttgttaagcatgtgcaaacccctcagggcaggacagagatatgtctcctatcctttacagtactgcacttgttgccttgaaattttttaatgaaactagaaaatttgtgaatgaattaagaaattctggtgtgtcagactgccaggcaaatgatcaaatatatatcatcacctaacagcatttcgttttgcaaagctctatacaattacaatgtcttatgctaaaattataatcaaacaatactcactatttttactataattttttttccattttttcttggcagttattttatgggttaaatgcatgattgatttatgtgaaagggaattgcatttgacgttattgactctttgccccagccttttcagctagaaaaaagcaaagctcttgctgtaacaagtgctgaaccttttcagaataaaatctaatgaggttagtatatatccttgacattttattttcaaccgaagtgaaggtcatagctgaaaggtcacaaagatgaatttatacagcaaataaacaatgttattattttgcaaagaaaatgcaatattcctgtctttagcctcttgcatgtaaaagggtgtttgtaatgctgattttagtattcaagtcctgttatcttttcatttcttatattttggaatgtagaaagaggaatacacctagcttatctataaaagactagtatgaaatgtgtgtattatcattaatattctagtattttattatttgaactttacatttaagtcaaatctactttgtatttgttgggtactaatttttttggtggaagtaggtaattactctatttccttggtaaacttctttctgacttgagagtttagtcatacataagtccctcaagtctaccatctttggtttttaacaacaaaactgtacatttccaatgaaagaatatatcaacataagtttggaaaataaggggctgaattatagttaaatggtagaaaatctgcctttttgggcacaatgtacaacaggaattcttaactgctttcatattatattactaatacgtaacatgggattgctctattaaatttgtaccagatcaagacaattttaatagtaaaaatagtttcatttatttaaaaagtcattaaacaaagttcaaatgccaaaaaccatgtcaaaatggtcactttatattgttatgtagttaatatattttagagcaaatattccaaattttgtaatttgctccttttaaaaaacaagcataagataggcatctaacctagaatttcctttattttagatgaactcacaaattcgtcagaaaccagattgtctttggaagacctctttaggaaagactttgtgcttcacgatccagaggctcggtggatcaatggtaagtgtatacctttttaaacattgtattcattttgagttctgtataattaaaattttaaaaaatgagatgtgtaagctgggcgcaatggcttatgcctgtcatcccagcaccttgggaggccaaggcaggagaatcgcttgaacctgggaggcggacgtcgcagtgagccgagatcgcaccactgcactccaacctgggtgacagagcgagactccatctcaaaaaaaaaaaaaaaaaaaaaagatatgtgtagttaatatttaattgaaagtgtacttcaaagattacatgggtattatttaaattaaaaccttggttcttgtgagagaaaatcaattcctaagatagggcgtcaataaattatttggcaaacattgggttgacagttttgtatctgctgctctctcatgatcattagttacatgactttaaggatgtattacatctctagcacatcactagataatttttcttagtttggcagtgtacattttgggagctagtacgtagaaatgttaagtgcttcagatttgacaatatgattggtttttgttattctctgtggcttttctttttaagcttaagtgttacaagctagtgagactctatgcaaaattgaaatgacttggaaatatatggcactttgttgtttttttttctggcctggcaaataggactccttaggttctcttaagtcaatctctgacataaaaataagaaaataaaaccactgagtggcttcataggttttgctttgtctttatggaagatcataagggcataatgtgttggtgaaaaggaaatcagttttttaatcctttgaatgttctaatttgaccaaccatacgaatcattatggttggatagctgttaatctttacccttcactttatttgggcataatatctttgctaattttcaaggcatagagtgtattatttgtataatagatgaaaggagctttgccttttcatataataaagatcatcatacttacagtccattccttcctctctcttactctacttaagtgtatttatgctggtgaattaaactttaatttatggaagctatataaagagaatgtaatttaacccatgagggcaaaggccaaatcacgtgtgtttacttgacactgatatgtctcctggagatctgcaggcactcgagattggttttttgaataaatgaatgaatgattttaattgatgtgcagtctcattttcacataaacttaaattttaattgaaatcaattggaagataagtgtgtattgtgatgatattacggataaagaacacaaggtagcgtttttcttaatgaatctgtatatttttattttgaattgtttataaatttgaggctagtcatatttttgcctttgtactgtgattatttcacatatacactataatgagtgctatgactaaagaaggctaataaaaaagatatattatcacaaaaaattgtccaaatacacaaatctctcataaataattcttctaatgtgtgattataattatgacaatcacctgtttactctttagcaaatattttctattgagagaaatgacaaaatgaaagttgctaggtttttttaaacagtagtattatgagttgttagatttgaaatgctgaataatcttgttttattcaccatgtttttggacaaattatagacattttgtagtctttgactttggaaaacatgaaaaattatgggtctcatctcccttctcaggttagcttggactatttagaggcatttactcctgtgtataactgactctgtgatattgaagctccgaaggacaggacagatatttaagtagtgaactgcatgctaaattaaaacatatttcaatatgtaggacacagattctactcttatacttcataggttaccaaaataatatatttggagtttatcatttttcaagtaatttctttattaatcattggttaaatttgatcctaagaaggcatctgggacaaagctgcagtgttattataatgttctaagtaatacctaaatatataatttttataaagaatttgacataaagacaactctttaaattggaataaacagaacctaagctctgaaagaatgcagtctttataaataccattgaaggaactgtctcaatgcctgtaaattgtgtgcactgagttactttttaagtatagaaatggatttgtgcttttatccaacccagatctttctggcaagtgctagatacttggcctatttacgtattcctcacatagcctggaaattcaatgggaaatatatgagtaggatgtgtaaccttggcctcattatcaacagttatatctaaatgtaacctgtgagctttttctttattctcaagtgatatctcaacaggttttctttgtacataagtcacttgaaggagttcgagctcagcttatttggaagcatcatttaattcttggaggtcatcatagaagtgcttaatgcattattggtcaaggggaaggagggagtctagacggccctgacatgtgtaggttatagtgaggcgatgccattcattatgcttggtctcaaaaaatatgtctgagaatatcattgcagtcttggatgggtgcccctgttcatggttagcttaacaacggccttaccccaagtctgctcatatctttgaaatctacatttttatagcatcttcattctagcaatgtcaccttgaaatttgaaaacccatcttatttaaaattattcattctatccacacacatttgataatcaattaatcaccaaagaaagatctaacattgagtgccttctattgagactctgtgatcgatgctttatgtacatatttcacaggactgcatatgacattaaagttaaccccagaaaactgaggcttaactcagaaacttatccgaacacacacctaataaaaggcagaggctgctttactcattatgcttaagtataaaacttgacctctttcattgtttgactctgatgtgtcatcctcatatctaacatatttatcaagcacctcactgacaatctcattttaacagacctcattgctgtcgtagggtggaaaggtatgaaagccttcctcacccatcataaaggtcacagccaacactgctgtaacaaaagaccagttaaaaagagaaaagcataacaaatttatttaatgaaagttttatgtcacttggaagactttagaaatgaagaatcaaaggcctagggaaaactgtccatttgtatgcttaggttaaataaagtacggacagtgtattgaagtgtgactggacaaaaagggtatactctaatgataataaaatgagggagaaacccagcaaagcttacctgttcagatccttcttggcctccctgtgtagcatttcatcctgccagatataaggcagaactcccccggaaatagggtcttatgatctattatctgaaaggtaggtcagtgcatttccttgtgacagctcctacacagaaaagcagaggaaggttaaaatatttttaaatcttatggtttgcttggaaagagggatgctagtttcttttattattgttattatactttaagttctagggtacaagtgcagaacatgcaggtttgttacataggtatacatgtgccatggtggtttgctgcacccatcgtcccatcatctacattaggcatttcccctaatgctatccctcccctagtcccctaccccctgacaggccctggtgtgtgatattcccctccctgtgtctatgtgttctcattgtgcaactcccacttatgagtgagaacgtgctttgtttgtttttctgtccttgcgatagtttgctgagaatgatggtttccagcatcatccatgtccctgcaaaggacatgaactcatccttttttgtggctgcatagtattccatggtatatatgtgccacattttctttatccagtctactattgatgggcatttgggttggttccaagtctttgctattgtgagtagtgctgcaataaatatacatatgcatgtgtctttatagtaaaatgatttgggagtaatgggatttcaagtttttgtaacctttcctggggtagaggaatctggtttctattacttgcttcagggatggcagagaggtaggagacaggaaggcagaaggaggtcagatacagactttgcttctgagactgctcagaggccttccaatatcttagtcagttcaacgtactcagcatgccaccatgccatacttggaggtatcattttctgagtcccaacactattaattttttcatgttgaatactacaataatatgtttatttccccaggtacattcatgtagtggtaacttatacagtcactaaaactagagtttatacacatgtttattgacttgatcatgatctagaaaagtgaacaaagtaacttcaaaacagcattgatagtatgtgatatcacattgtctattgtgtaacagtgattgtctccagattatccctttctttttacttattttgttttttctcgatttttttcaataaatgcatgtgtttacatagtttttttttataattttaactttttattttagatttagggagtgcatgtgcaggtttgttacatgggtatcctgcaacgttagcactctcaggatattcattttgagctattagataaaatcaatcaagtgctattttatttttaaactttgttttccactgtgtcagaagacaattccaaaatttatctgatggagtataaacaattaaaattatcatttgataaaaaaaagttgtaaattttaaatacatttgggttccagtggacaaacataccatcatgtaatgagattttaccgtgcagctagtgtgtcctttactcaccccatgagtttgacaacacctgctcagtgatattggtccacttaccatttgttatgaacctgcagcaatatcaaattgctatgaaaatttttaaatgtgtacccacaattaaacctacctgctctggaccagtggtcaacccttcaccaactggctgtagtaagataacaacactcttagcacagccctttcctaggagactataaacgatgaggaataactgtcagtattcaatgagtgctccataaatagtttcattataatgagaacagtgtatatgtaatgggatagaagttgtttcacatttcttttgcaaaatggcatgctgggataaatgataatatgtgaggctttgggttttattttgatcttattggactcatgttggaaaaaaataaactcacttgttacatgagattccaacacagatattttaacctgctgtctttgtaacgtgtgacagtataatatgtggaaatgggagactcattaaatcaaggtaagccatggcctttcagcaagttatctaagcctcttaaggcttggtttcttcattcagagtgaggacattagtgccatagctagaagcataatacaaagtaagtgagcaaaaatatgtaaaaagtgaagataaaaggtaaaagttaaaaaaagaaaagaaaaaaactataaatgaaaagtcaaggtctgtagccttgtggatcttcaaatggtagcgattcatagaactgatgttagagatgctctgaacacctgacatttgttaataaatgcgctgggaggtctcattctcataatatatgcaggatattgaagaggcagtgaaaagtcactattgtagcctgtatgaaaaacaagaaacattattgtaatatatcaataatatttacagtaattaggggaactgtaaataggaaaactaaacaaatacatctttgttgtttcttgcttgtttgtttgacactaatttgtcatactagaattattgtccatcaacttcacttggtagagctgcagaagttgttgtgtttctcagtgcacagggagctacttctaactccaaagacatcattaccctccctttagcctatattcagcccccagtcaaaattatcttatgtttatcttattttgtatcttcgtgaccaaagtgttattttttataatcatcaaccaaactgatagttaaataaaatagagttgaatttatattcatgaggctcttgaagataacacgtatttttcttgcaacataatttataaagataaaaccttgcatagattctagatgcacacaattaggtatatggtcaaataaatcaatttgcatctttttaatggaaaactaaacagctgtaaaaattaatatttaaaatattagtgacattgaaatatgtgcagataatatattaattgaaaatagcacaatatggaattatatatatagtgtattcacaattgcattacttgcatatacacacaagtatatgcaaagaaaataatacctgaattcaatatgccaaaatattaaataattttctgttagagtgattgagttgtttttattttttccctttctgtctatattttccaaattttcaacaggcattctgctgtttcctactatggcaattttatgtactaactacggatattcaaacttttgtttgaaattcaaacctaacaagtaaatggttactaaaattctcattatggtagatgcattcagctagacaaatattaattttgttattctgcctgtgccttttttctcagagatctgtatgaaaaggaggtacagagaggagcgtgaggttactgaacctgggagaatgagaatgttcttagcacagcaatgactattagacttaagaggcatggattcttataacagcagtttcacttccttctttcccaatagattgagacataatatttcctgtagtttattatgttcttttttcttccactaatccaaacctctgcaacatgcaatttatctatattacaaacctaaatagtaccctagcccccaaagggtttttttaaaaagtcaaaaataacaaatgttgatgaggctgtggagaaaagagaatgcctatatggtgttgctggaaatgtaaattagttcagccactatggaaggcagtttgaagatttctcaaagaacttacagcagaactagcattggactagcaatcttattaatgggtatatacccaaaggaaaataaactttctaccaaaaagacccatacatttgcatgttctttgcagcactattcataatagcaaagacctgaaatcaacctaggtgccccaaaatgtaggagcggataaagaaaatgtggtacatatacaccatggaatactgtgcagccataaaaatgaacaaaagcatgtattttgcagcaacatggatgcagcaggaagccattatcctgagtgaattaatgcagaaacagaaagctaaatatcacacattctcacttataagtgggagctaaatcttgaggatgggcagacgtaacgataggaacaacaggcattagtgactccaaaggtggggagcggaggaggggaacaaagcctgaaaaacttccttttgggtactacgttcactatctgggtaactgggatcaatgaagtccaaatctcagtatcatacactataccttgtaacaaatccacacatatacccccaaatctaaaataaagattaaaattttaaaaatcaaataaaaagtaaaaacacataggaggctattgaaataatgacatacctagttcctgattcacagaccagagacttgtaaatgaaatttggaatgtaaatcatggttatcaaggctgacttttcttttcagagttatatatgacaaagtatcttcctatcaagagtagataatttcctactaaaactaaacaaatgcttaaaaagcataccatgaagcatatttacttctctccaaatgaccaaaaatgttttatttattgctatgttgtttgtaaaattgtgcttttaccaaagtttagattaaatttcatctgtattaaaactgtttgaaatcaataaaatggaaatatctactataaaaaatcatactgtggcaatcttacatactaactacgatattcaaacttttgtttggaatttaaatctaaatagttttcttcaagaaaatatttttaagatttcagtttgtctaaaaatgacaatacttaaactaaacaccaagagagagaaaagggatttactgataaaattcagtgttaacatttaggaacaaaaaagtatgtaagaaaaaaatatatttctatcacctaggtatgcaatgatcaaagtatttaaagagaatttgaaacacaaactaaactttagaataaagaagctaaatatttatgttaccacttatttcttgaaatataaaactatattttgatttttaaaataagaaaaaaaagcttggggaaatgggatgaaagttatgttcagagttcatcaacaagcatttattgagcttcatatatgtgctctgcacagagcttcatatattccagatggaatctgtttacatttgaaaagtttgtagtaaaatatctggtgtcctcatagtcctttgatattctatacaattgttggtcttggccttgatggcccaggaaatctgtttgtcaatacaaatatagaataatagatacattgacattgacatctatctttccatctatatatccatctatccttttatctatccaacatgtattgaaaagattgaagcacagccaaacatttttctagatacaaagatataaaggtgaataaacacagtccctttgatcaacgacattatgaatataaagggtttttttcctcattgagcacaaatctttccagttgtctcaggcttaaaagtaaaattgtaatcaaaaggctgtgaatgggacagaaagtagacataactgaagagttgcaagaaatactcagtccaattacgatgaagttttattaaccttctccaaaatcaaaaacacatcttcacatcctacatctctctctttactatgatgcagggtacacatggcacattttatttttttgagctgctgtgtacgccctgcctctctttttatttgatacagtcttcacttacatatggtaatgatcatgactaatatatacatgtaccactgacatgttcaaaaaaaaaatataattatggtacccagagactatagaaactagatcaaaataataggcctaaaacaattaggtgaacaataattaggtgatccatttctgggtaattattttttaaaaacagatgttgcaactaggagaaatcggtttgagttaagaacggttggagtcgtctttatggaaaagataaaattcagtcgcagtctagagggcagatgagcccaggggatgaatgaagatattgttgggagaacaaggatgtgttatgacaaaatcacagaaattagcatggtgtgtaagtttaacggtaaggaaaatgctgtgtatgtgtgttcggggcctctctatgtataaaagtaatggaaaataaagttgagtaactcagtattggcatatgattagaatatgtatatttgatcattttactgtaattgttatactttgatctcctttagcagattaaccctttattagctcttaatttgaaacagaagaatttaaaattgctctgataaatgtcagctattttgtgggaatgggagttgttagtagtaggaattgaagtgggagatattagtaataggaatttacctaatacgtgttcagtaagtcaaaatttgcatgtatgtttctacttttctaggacacttctacatatgctatttatttgcatttttttgaaaacccttcttagggaggcaggatgggcattatttttgttttatacatgagtaacttgagaagcaggttttttccacttctctcagattcactcagtaataagttctggctagaagccacatctttcatgtttaatgtttggtggaaactagagtagagaaaacgtttcaagtgaattttttttattatcatgaaactaacatttgacagtgtttataaattaatttttaaaacacatagatttaaggaaaacaatattaaaggaaaagtagataagaataaggaaagattttctttgtaattgtatatgaatgtttccattttattggaatgtttagatatttttagaaaatgtaattgttcttatatgattgattttacatgtaaaaaaagaagtcattgcagataatcataataagaaactgaaacttaggacatattttcattttttaaaaaaatgtattctttcttgtcaacttttattttagattcaggggtacatgttgttacctgggtataccaggttgttacctgggtgtgttgtatgatgctgaattttgctgtatgattgaatatgtcacccaggtaatgagcatagtacccaacagatagtttttcaaagtttgtctcccacattccctccctaccccctcttattttcaccagtgtctaacattcccatctttatgtctatgggtacccaatgtttagttcccactttgcttgtggtatttggttttttgttttggtttttagttttagtttttttgtttctgcattaattagcataggataatgtctcaaaatgcatctatgttgttgtaaaatgacataatttggcctttttatggctgcatagtattccatggtatgtatgtaccacattttctttatttcttttttttttcctttaagttcatgtgcagaacgtgcaggtttgttacataggtatacatgtgccatggtggtttaccgcacctactgatttgtcctctaagttccctcccctcgccccccacccaacaataggccctggtgtgtgttgttcccctccctgtgtccatatgttctcattgttcaactcccacttatgagtgagaacatgtggtgtttggttttctgttcctgtgttagtttgctgaggatgatggcttccagcttcatccatgtccctgcaaagcacataatctcattcctttttatggttgcgtagcattccgtggtatatatgtaccacattttcttcatccagtctatcactgttgggcattgaggttggttccatgactttgctgttgtaaatagtgctgcaataaacatacgcttgcatgtgtctttatagtagaatgatttataatcttttgggtatatatccagtaatgggattgctgggtcaaaggttatttctggttctagatccttgaggaattgccatactgtcttccacaatggtggaactaatttacattcccaccaacagtgtaagtaattgtaaaagtgttcctatttctccacagcctcagcagcatctattgtttcttaactttttaataattgccattctgactggcatgggatggtatatcattgtggttttgatttgcatttctctaatgatcagtaatgttgacctttttttcatatgtttgttggccgtgtacatgtcttctttcgagaagtgtctgttcttagcctttgcccatttttgatggggttgtttttttcttgtaaagttgtttaagttccttgtagattctggatattagacctttgtcagatgggtatattgcaaaaattgtctcccattttgaaggttgcctgttcactctgatgatggtttcttttgctgtgcagattctctttagttcaattagatcccatttgtcaattttccttttgttgcaattgcttttggcatttttggtatgaagtctttgcccatgcctatgtcctgaatgatactgcctaggttttcgtctagggtttttagtatgttgggttttatatttaagtcttaaatccatcttgagttaatttttgtttaaggtgtgaggaaggtgcccagtttcagctttctgcatatggctagtcagttttcacagcaacatttattgaataggagatcctttccccattgcttatttttgtcaggtttgtaaaagatcagatggctgtagatgtgtggtgttatttctgaagtttctgttctgttccattggtctatatgtctgtttttgtagcagtaccatgctgttttggtgactgtagccatgtagtgtagtttgaagtcaggtagtgtgatgcctccagctttgttctttttgtttaggattgtcttggctatacagggtcttctttgattccatatgaaatttaaagtcgttttttcttcttctgtgaagaaagtcaatggtagtttgatgggaatagcattgaatctataaattactttgggcaatatggccattttcacaatgttggttcttcctgtccatgagcatggaatgttttccatttgtttgtgtcctctcttatttccttgagcagtggtttgtacttccccttgaggagcaacttcacatccctagttagctatattcctaggtattttattctctatatagaagttgtgaatgggagtttattcatgattttgccctctgcttgtctattgttggtgtaaaggaatgcttgtggtttttgcacattgattttgcatcctcagactttgctgaagttgcttatcagcttaaggagttttgggctgagatgatggagttttctaaatgtagattcatgttgtctgcaaacagacacaatttgacttcctctcttcctatttgaatacccttacttctttctcttgcctgattgccctggccagtacttccaatactatcttgaataggggtagtgagagagggcatccttgtttttaaccagttttcaaagggaatgcttccagattttgcccattcaatatgatattggctaggggtttgtcataaatagctcttattattttgagatatgttgcatcaatagctgttttattgagagtttttctttatccagtccactgttggtaggatccttggttgattccatgtctttgctattgtaaagggtgctacaatgaacatatgggtgtcttcttggtagaatgatttattttcctttgggtatataccaagtaatgggattgctggattaaatggtagttctatttttagttatttgagaactctcctaactgctttctatagtggctgaactaatttacattatcaccaacaatgtttaagtgtttttgaaccattgcccctttcctctctcccatcttttgtattatccagcatctattgttcccatctttatgttcatgtgtactcaatatatatttcccactataagtgtgaaaatgcagtatttgatttgttctttctttattaattctcttaggattatgtcctaatggataatggatagtgacctaatagcctaatggataatggtccaagttcagagtctcatctgagacaagggaaatcccttccacctagtgcctgtaaaaccagaacaagttagttacttccaagatacaatggaggtacaggcattggttaaatatacccattccaaatgagagaaattggtcaagggcctacaggccccatacaagtccgaaattcaataaggcagtcataaaccttaaagttccaaaatgatctcctttgaacccatgtctcacatccaggtaacactgatgcaagaggtgggcttccacagacttgggcagcgccactcctgtggctttgcaggctacaacctccctcctggatgctttcatgggctggtgttgtgtgtgcagcttttccaggtgcacagtacaagccgtcagtggatctaacattctaaggtctggaggatggtgggccccttctcacaactccactaggcagtgccccagtggggccactatgtgggggctcctactccacattttccttctgctctatcctagcagaggttctctatgaggactccacccctgcagcaaacttctgcccggacatctaggcatttccatacatcctctgaaatctaggcaaagtttccaaaactcaatttttgttttctgtgcacccataggaccaacaccatgtggaagcttccaaggctagggatttgtatcctctgaagcaacatcttgagctgtaccttggccccttttagctaggtttgaagaggctgggacacagtaccgaggctatacacagcaggggggccttggacccgacccaggaaaccatttttttctcctagccctctgtgcctgcgatgggaggggctgctgtgaaggtctctgacatgccctggagacattttttccattgtcttggtgattaacattgggccccctgttgcttattcaaatttctgcagcctgcttgaatttctccccagaaaatgggtttttcttttctatcatatcatcaggctacaaattcccaggcttttttgtttgcctcctcttgagcactttgtcacttagaaatttctgctgccagatatgctaaattgtctcactcagattcaaagtttcacatgtctctagggcaggggcaaaatgctgccagtctctttgctaaagcaagagtgacctttactccagttcccaacaagtttcttgtctccatctgaaaccacctcagcctggacttcattttttacatcactatcagcattttggtcaaagccattcaacaaatctttagggagttccaaactttctcacatctgtctgtcttctgagccctccaagtctctgggaagttccaaactttcccacattttcctatcttcttctgagccctccagactgttttaacctgtgcctgttacccagtttcaaagttgcttccacattttgggtatccttatagcagcaccccactctaccagtacaaatttactgtataagtctgttctcacgctgctatgaagagatacctgagactgagtaatttataaagaaaagaggtttaattgcctcctcacagttcagcatgcctgggaaggcctcaggcaacttacaattatggtagaaggggaagcaaacatatccttcacatggcagtaccacggagaagtgctaagcaaaagaagaaaagccccttatagaaccttcaaatctcatgagaactcactcactatcacaagaatagcatggatgtaaccacccccatgattcaattacctcccaccggatccctcccgtggcacatggagattatggaaactacaattcaagatgagatttcactggggatgttgttgcatatgagatgggtttcttgaagatagcagatggttgggtctagcatttcatccaacttgccacactgtagctttcaagtagggtgtttagatcatttgcattcatcgttaatagtgatatgtgagaatttgaccctgtgatcatgttattacctggttgttttgtggactcgattgtgtagttgctttatagagtctgtgaactatgcatgtgtgtatgtttttgtggaggcaggtattgttcatttgcaggtttagaactcccttaaagacctcttgtaagactgttttggtgataataaattcccttagtgtttacttctctggaaaggattttatttctcctttgcttatgaagcttagtttgacagaagatgaaattatctgaaatttttttaatgatatgaaaatagacctacaatctctttttgtttgtaaggcttctgatgacaatcctgctgttattttgatggggttctttttgtaatagacctcacccttttctttagctgcctttaagattttttctttcacactgactttggaaaatctattgaatatgtgccttagagatggtcttcttatatctcataggggctcaacaaatttcttgaatttgtgagttgacctctttcatgagattgggtaaatttttatgaaatgtattctcaaatttgttttccaagttgcttactctctttctctcacaggaatgctattgcataataggcttggtttatttacataaccctgtatttcttggaggttttctttctttaaaattttttttaatttatatttgtcttactgaattggttaaaaggaccagtattttcattctgagattatttcctcagcattgtctattctatttttaatgcttctaattatattttttaatttctctagtaagtttctcaattccagaagttcagttttgttttttcttaaaatgcttgtgttgtctttctactcttggattattttactgctgtctcggattgggtttcagctttctcttgaatcgcattgagcttccttgttaccaagattctgaattctatgtctgtcatttcagccatttcaatttggtaaggatccattgctggagtgctagtgtgattgttttgaggtgaggagatactctgactttttgaattgccaaagtccttgcactgattccttcttatctgagacggttagtgttattttatctttcagaagttgctgtcatttggatgaggcattttgtttttatattctttttctctctggagggtgtgactgtagtgaatgttttgtattgttaattggctttgtttctgggtgctttcagagggttaagcctctgtacaggttatttaattatagctagatctctacattgtatttcacaggcagtgtgtggaaggcatttttgtttggtggtgtaattcagactgcgttccattagatggcatttaagaataagagtcagcaggtatgttcttattcaactgtgtgccttttttgtatttcagtgcatttgtgtagtgttccaggttggaggagttggggggaatcaggggatgactctctcaccaagttttcattcctgggacttgggggagctccctgtagtctctggtgctgtgcccacatttctttagctccaagggaggcctaggctggcagtgctgtttcctcccatggagtggcctgagccaaaggttaggttggcaggagacccgtagtcccctaggggcctgctatacctctgtacttgacagagtcagagagggttgtggggtatgtctgctggtggtctgttgattcagtcggtcagaggtggaggatcccaggaagggcagtgttgctgtgggtgtgcagctggtgtggtacccagggcctagagttttttgcccagagattgctgtctggacttcccagcttgtgcttgactgatcaggtctccttccagtgtctgtcccagtactgagcttgcccagctagttttgtcccaagccttttgttctccgattgcttgtctgttaggtgctgcagggcatggagctccctcaggcagaggctgaggatggcagataggccacacccttcctagattggtcttccagagcatggtatacccagctgctgtgccatcccatgatcccacacctcagtcttctctgtggtctgagagtgagggctcctctcctgcttgagctcaagatctcagctcaatacccctgagccgtgtgttcaaattctagggagttgagaccaggcatgcagctttgtccttctgcccatctgggtcagatactacctgttctgcgggagggcaaagcaattccagactaatggcgagacactcaggtggggcagtagaggttgcattgtcggcatgctcttgatggagtggtcaggcaggggctttgagggtggtcaatggacaaggggatgtgcagaccagacatgcccctttcccatgggaaaaacagccctgtttcctgcaccccctcatgcaaaatcttctgagttcttctcagatttgagctctgcctctgcttactctccaagcagttcccctgccgattcaaatgttttttggggtcacaggatctctcatagctaggatctcagaggtctgtggcaggagtgtggtgtcccgcagttcctttattcacttcttccttaggacctgttaagggctgagagccagttctggtgctcagcaactttgtgcagcttcctccctcttcatcctcagtgtttgtgttgcctctctgtggactttcagttttctcccagaggatctgcttgaggtgtgatggttcactggatattttggtttctcttggttggagagttgcttcttggctgcatctagtcagctatgttggccccccaactccaaattttcatattaaccttttaattcaacttgctttgtttttgcatgtatgtttgtgtgtgtatgtttgtgtgtgtatgttttgtgtgtatgtttttgtgtgtatgttttgtgtgtatatttgtgtgtttgtgcatttctttatgaatggctaaatttacttaatcagcttggttatacagtcaattcgaatgagccattgagaactttggataactatcactggtttctattgaataaacaagtattaaacatgtaggtgcattccaaaatgtctttagcaaggaaatttctagagataacattccttatcattaaatggctaagattctatatggtaagttatgttttgtaagtggggcaactaaggccagataccatgctctgcatttttagtttattatatctaatgtttatagttttctaacttaggtagatatatgcttattttataaatgaagagcttgagtttaaagcaaataggtgacttgttcaagaacacagagataaattgaatctatacttttttttaacttatatgtataatagaaaaaatccataacaaaaagctttatataactggcaggtgacgttttccaacttttggttaagctgagtaacaaacagtgagttccccatttctgctaatgttttagagaggttgggtgatcatgtgataaagatatattagtgagattcatatagtggatacgaaattattaaaaaataacctctaagttcaacttcaattctaatattttatcagtttatcgccatgtcaacataaaggtacagttgaagctactgttttaatttttccttgttttaggaaaccagttgatacattgttctagacctttcctagggaatggtgtcagctttcacagaaagttgtctgcttttcatttccagtcaagaaaactctagtgtttgacacatagctctttgctctttgatttgattggccatatggagttgttaaaacatttaaaagctgatctcaattggactttcagttgataacaccttggtatcctcttttgtgcagtcataacccatgccagttttcatgagcttgaacattcattactgggttcatgacccaagccattagcccatcactgccatgcacttgtcaacagcatctgaaagcatgaagcttaaacctatctggtctctggtgttattcaatttgtgagtgaaaaaatcacacactacctagttaatgtgtgtatatatttttcccttctcctttgaatttgaatgttctctgggttttctaccattaccagtaatgctaattatttaatttgtctctgtcacccacatctgtgataaaatagtttgtttgcacattgtactccttagcttttaatttctccaagatcctattatatttaaaagatttaaaaatgtgaaatctcttaagtagagaagtcactaagtccttgtagaccataaggattgcctgctctcctcagactcatggttaagtggcatcagtggtctgaaccattcagctgtgttgttctctaaggcccaaccaaccaccaaggtagagaaggaacatatctgtgaatcagtgtacagtacctgaaatgggaaggttagttctgtgtctaggagacatggtgcgcaagttacttgacttctgtcagtggccatatcttcttcacctataggactgagaggataattcctcttatgcctttcttctaaaggcattgtgagcatcacaggcctatgctttctaaacattataaaccacttaaaacattcttgactccatctcttattgaataaaatttatttttcatttctctagactctatgactttgggcaagtcaaccagtatttctgggcattagttttgtcaaagcacctgagtgataaccacagttatttattgggagttgagtatgtgcccatcatcgggccaataaggtttggttaactgtatttattcctcatgaattattttcattgccttcacttgatggctcaggaaatggagcagagagagctcggtaacttccctaggctcacatagctagttagtagcaaaggtggaggtagatgcttcaggtcattaaataaggtagcaaaggtggaggtagatgcttcaggtcattaaataaggagggattaaaatatttcatggaattatcctaggtggcgtctaggttcaaagaatgtaaaatgcagagaataaaagatctgctttttttttctttgttttggccaacttttttcaccagcctgtatttcctctcctttctttcttatctgttttgaaattccaattgctgccttcactttggcagggtagatgggggtggttagagttgccttccctactgtgcttaagttcttattgtgtaaagatcctgtaactcgctaaattagcttaaaaagctctggttttgttttcgtgccagcatattacctcaccacactatcactttttaccctccaagacttgccataccaagtggcagtgctcaaatcacataaagaggagccgttgttgcttgttcgctagtacgtgggtttgtatccccaaaccatgtcttttttacatgatactaattttgtctggaatattcttatttttccatacaaaaagcaaattcctgcttttccttatgaaacatcagtcagttcttctgtatactcaaccatgactttcccagacatcttttttttttttttttcctttaagttgccagcatgacttttatgcttagcaatgtttggattccatgttcctaaaccgaattttctcagagcagggatgctggtttttgctttctgcattttcagcatcaaacacagtatctagcacgtagttacgctgttgtttcagcaaatgaattactactttggtacaacagaccctaattttaatttgaagattgacacaattgtgaaggtatactaaaaagttttcttgaaattttagatgaaatataagtagtagaggatattttttctccttccaaaaattaaagagaagaaaatcactcagcttaattttcgtttaacaaaaaagaaccaaagtgttatgactaacactgtcacagagtatggtgtgattactgatgatcaaacttctgtagcaagttacatgtatatataaagactaatactgttcttccaattactaaggtaagttcttagaagtaaaaatatttatgtttagattcctgaaatagtcactaatcatgaaactgtattgaagcaaaccaaattcctggaactagacagactgtgatagaatccagtaggctgatggaggtactctgcatgacagcggggcagatggatttgctgaaatccagtgttgcccaactacaaatctgccataaaagaaaaatgcaaacatggagacttttaaaataggaataatttggactctcacagaggaacattttcaagttatggtttaggtgggcttcttagagccatcctagattccaagaactaaaagtaactgcagacatcaggcagagatggtccaagttgtcaagcagaaaataaatgcattactcaaaacatgccatctcttcataagcactcttagaatttccatgtttaagaatttatttttttttctaagactgggattctttatatgaaagtatttttttttctccttggttttttaaacatctcaatacaatggcaattaattctggaaagtcaaaaccagaaagcgttttagagagtcttccttactttgccataaggtatttaagatggaagtctgttttagtttttcatagatcttacaaggcccagtccagtgcttaaaacattttaatgttcaattaattttatttgagctaaattggattcatatctactgctcaccaccatccacaagcatcatttcaaacctgtttgggaattaaaataaatgaatcctgggatgactatggtttgtctcaaggtcaaaagctgtgacagagctagatttaacatcaacagattccttcttatttatgttactaatgagtattaatatatattactgaactttttgaccttctgtaatgaaaatttctgattatagatttattttgttatgctaaaatatatgcaattttaaagaaaaaggacaccatcagtggttggcagtcagagccagggattttcttgagagctgatactgaagtattattgaaatgatataataatatattattgaaataatattttttttccattttcttcccaaaggatgcctataatgctctggatgactctccactctcagccttttatatctagcacctcattcctgaaaactttcatctcttttcactattccatgtattctgacagcatccgaaatttaccttacattacttatatcattttcttgtgtataggaacaattctactcattaataccaccactgctgctattgaaattttggttctatgaatatctcaattatattccttcttctttactttattatatagcctttttgtcctggtttattccttagagttttatgctttgcttatatacaatgtacattgctatgtatgtctttaagttagtgtacagatttttaactgtcttaattgttttagaaaaatatctagtcttccaaaagtagatcaatatcagttaattggcttatctaccgagtccttaggatgatgttgtatttgtcttcataatcattgatttatttgttcctgtttgtctttgaaggaaggtctgtctatctagactcagtgtttatttctcttgactttgctgggtcttccaaggtccacacatccacaggtgcagttgcctagctcccagctcacttctcagtgtctaatcaaattccaactgttgcattcctgtaataattgatattgtgtctttacttatcgctccaattcttaccccttcagcactgaaaacagatagtgtacatgaaaaatcacattgcacccccagcagtatctttttaggaagatcggtgttggtcatgcccaagacaaaactccttagttgtagggaccttatatcccgcaatatgtggaatccatcactatcttcttaacccatcctatatacgaagatattttctgcaatttgacgtccctaatagatattgtaagagagacactatagggaggagagggttggaaagtaaaggtcacatactttaagtagtacctaagcagcagacagaccgcccataattatctgataaatgcagccatttgaattttagatgtaatggacagacagtcagacaatagtaccatggcatagagttttttttattttggttttgattatgtttgtttgtgtgtgcgtgtgtgtgttgtttttaaactactttttggcaacatagcctggtggtccaaatgttgggatttttagttaaattctagaaaatatataggtcacggatgttcttcccagtgtcttaaaggttgacggttctagttttcagtgtaatatgatgtctactatatacaactatatatgtctttattaacaatctaatagagcttttggagagcatgtgacaaatacagctaaccaggcacaattttaatattaactatcatatgactttttacttttttacgttttaaagccaactttttctactttctttatacttttctaagtgtttcaaattattaaaatatgtcttataatttttaaagatcctaggattaataaatcactgaaactttaacgaggtgcaatatcaaggcagtcttttgtttcagaaaatgattacaattattaatgaataacaagcactaatacaactttgtacatctttttgttatgtgtatgactgacatttatttatttgaggttatggtaaaattaaaattctatactatatctaataaaactagttttagtatttgtgcaaacagaagttgacatttgatggagatgcaaaaggaaaaaaatactcattattctaggttttagattggaatctaaacatttctaattgaaaacagtttaggaattaaagaaaccttgtcctagttctgccttcctctggtgtgtgtttaggttcatgtcccttaatctaagggaaattagatagctaaaagtcatcagtgaattcagcacacctttattttagcctttgctgtaaattaaggtctgtgaccattattgaaggtttacctgaactccttacaatattagttttccatttcttcttgtcctgagtttgtgctaacaaaatcatacgaagaaaaagagaagaaaggccgaaattatgacagagagagaaatataggatagcttctctgaataaagcctaagcctggggacaggaagtctacagtgtgccatatttctctcctttccttctggtagcccctgggggccattgtgaaatctccagggagtccaggagcacaggatagaaaccatgacatgggaggttattgtgagattaaaggatgtaatatatgtgaactagtaatatgcaaactttacaaatgtaagattcagtattattttactttctatcaatttaatgtattttaaagtagtcatcatcttttcccaatgtattatttattccacatatttgaagcaccatatcatatcacacttatccttaattgtcttcaggtttgcagtatttaaattaaatcactaattcaaattgaaaaatgagaggaactattagtttgtagaaatgtacttattactagattaaagtgtggcaattccagttttttcacgatcaagtgactatgtggtataatatgttttcatcaaaaggctgcatgttattatgaatttttaaaagagtgtgatagtcggctccttttttaaatttaattttaattgaaattaattttaattttaattttaatttaatttaatttaattccaaaatattttctttaaataaaatttgacatcatcatagaaaattatatgatatcaacaaacttcttttctatggtaatattactgtatggtaagtttatatctcattatttctgtgattgctatctgcgctttattttattttctcaagaaaattgaccattttcactaataatataatttactttaagtaaaggataggctctgcatatattaacagagttgtttgagttccagctttcattgaaatgatttcctgagaattgattgcatgccggatgctaatctttactacaatagctgaaaattcacatttcaatatatctaacagcaaatgatcagactgctacccagacagtgtgattcatctatagccatgttaggctgaaagtataaataaatcaataacacacactggtgataaggaaatgttctcaaaagtacatgaaagaaaacaagattatttcataaacaagtctatatattcacaacaaaggagaaagtagaagtttagattattataataaaaaaggcatctgctttatgtataattaaatagtttttctatgagtctgtaaaaacttttacacgaataattgccttatttttcctttgtagttatgattacttaaatatcaatttattaaatgcctgtcctgtgccacacctatattcagtgttagaaagatgaatgagggattataactgaacttaagggtgagataaagctgtgggcaaatatttccagtaaaatgtttgggtgttacgtaatactggaaatctgtttaagacaagaagtataacagcggaaagatggactttctgtggtggaggctttacaaaggaagtagagctttagtagggttttcaagaataaatagaaagtgtgaaatgacaaaggatgggccagagacattccagattgaggcaacaatagtcttcacagtacagatgtggccagagtgctttctgctcggtatttgagaaatgtcttatttctctcttctatgattcaatttattggctgattattctgcccaagccaaaaaatatgtataacttctgtttatgttaatccttgtaaatccatctctaatgcacagagagctgcacgtggaagaaaatgtgttagatcagttttcagatttgactgtacaaaaacttgggttctaaagacatgtctgtggagctgtggaaggaaaagctgcatgaaggctttcctgattccctgcttcaaccagaacagtctcactttaaattggttttaatattgagatttctcatttggaataaacaaaaacattgaattgcaaaaagaaaatatgtttaactgaaatctcctatcaaagacagccttgtggtcgcttttcttgtttaatctcttgtagatgacagaaaaattgagagcttgtttatagacttgggaacacttaggctttgaaatccatatttacttacttgaaggtcagtcatttttgccccctgatgattttagaaaatgtcagggaaacaggcacagtaattgatcatattaggatggagtgaatccatgaagaattgacagcttgatctcgaaagctgtagtgtatgtatgaggatttgtagagaagtagaaaataagtaaaggcctggagaaagcagagtaaacatagagtagaacctgtacagagtcaaggactggtacactggtctcaattctactctttataaacaaaataaacaatggaaagttacggtttaattcctggattacatgatggttaaaatggaaggatagtttttaacaagaaggtacatttaaacaaacaaggactccagggtactcagattcttcatctgcctattttactgtctatttcatctatttctgggaacattatgtacagaaaatataagattaatccaattttagcatgtatcagaatcacctggtggatttgttaaaacatgaactggtaggccttgtccctggaatttctgattcagtaggtttggggtacgcgttaagtattggcatctctcgttaagcgccaggtgatgctgctagtcccagaactaactcagagaatcactgagataaacaaactgtataaataaattcctggaattgagtgtcttcttcaaataaaaacaaaataactcccatttttctgcccaaagagttgtgaaggcctttgttattgaaaacattaaatgaattgttaaaaaattaaaggtttaaacattttgcctaaatgaatattatagtgctggctacatttattttaatgcatttttggggatcgtacaacatctgctactggtatttcccacaaaatttgacctgtgtttcttcaactcttaggtttaccttagtctacaacttttgctttcacccgcccgtcatgtgaattttaaattttacattttgattttcaagttgaactttcatgttgaactgcttatgcttctcaaattgctcctttttctgcaatttaagtataatacaactggatgaaagaaggagtctcttacaaaatgtagctcatagctcataaagatatttgcaaactcaccttttttaagaaacaacaaatgtaggcttttcaataaaatacgtgaacttgagctctttataaaacaccacttgaagatcattgactttgaaacaaactaattttactttattgaatacctttttcccttcttcaaagatttccaatgctgtatattgattgttctgcccttttcaatgtcattttgtttttcttgctgcaaaaccatactctgagttacttaaattgtatttatcattcccagtattatttttttctttagcacaaacccaaacttattaagaatgctgtgatgttaatttcagaagaggatagcactaaaggcagaataattctgatatccaaatatttttataaataacatttgaaaaacagtatatattttggtttagtctactattaatagaggaaagttatagggaaacatattttgttctaataagaaagaatatctaaaaaaacagagcaggaaatcaattaaataatttgctgatactttcataaatgtcttcaaattatgttgtgattaatacttataagaactatttttcaggaggttccagaatagagtgagtgttcatctgagaactcatctgatccccttacagttctaacagggactttatatgctaatttttctcctaatgatggttttctatgtaatgtaacaagtcttaaagttttcttaaatattcatgtattaaagtgtataaaattccttggagtgttttattttagagactttttcattaatagatacaattttgttgattatagtttaaatggaagggatataagtcaaagaaatattattctcaatatgaattatgaaaggagaacaactttaaaaatacttcataatgaagtaagaaaaagagtacatgaaacatcttttgggtttaaagatatgaacaagtgatttctggtgatttttttctttttaattgcaagtctgtttggctatttctttggcttctgagcatctcttaagagagtgaatgaaaaggtaatcattaccctttagaggtaaaaaaagtctctgcaggtttcatagaatctatttgatttcaataagcattaaaatgtgttgtaattttgcagggtatctcattgaatgtagagccaagattgattctgttgagagctcaactagatgaaaaacgtagccagtatgaaacactcttaactggctcacatccttgcagtgggactatcacacacccaggcacccttacttgcggtaactggctactgattcagcaactgaatgagagaaaaagattcttaatgaacctggatcagagaccagattgctgaccagctcctggagttaataatccatcatatgaagtaaacacataaccatcactgaagttagagtaatgtaagcgttgcacctgacagcagtatggtgtagggagaatgagtgcagttattcctggcaggtttgtactggaatcttagcctagatctttactttgactttatgccaattatttaacttgcttttgtcactgaaaatagaaacacaatcaagacataatatctaccttccctcaaggaatttatggaaaacatagtcagttgttgatgctgtcaagttattgatattgtgataaatattatgcacaattacaatagaggtttgtagagctacggtaagaatagtatagtctgcccttggaagccacaggagggttgcctaatgaaagagatcagggaaagtttcctggaggatgggacatcttagctgaacatagtaggaaaagtagaagcaatagctctttagtaaatatgcattcagtgcttgtctcttacatgtcaaacactcagataataacaacataaatgaactgtttagtaggacaattccaatgcaatagaaaatcttactatgcatcttccttcagacgagaacatagatgtttagggaggtcttataagatcattccttgtacagtgccttgaagctgagtggggagtcaaagttaacatttatctaaccctgtgtagtgctctacagaatgttagaatagtagatttgaaagtcttttctattaagattatattgaagctttggaaatgaatgagaatgctaattgatcataggatgaaggggaaagaaatctgagcatatattataccagagggattcccttcccataggaagtaagaatatgaaaaaggagctcaaaaaataagtggaaaaactcgaaaaaggaagaatgttttcaaaagagcatagtcaataggagtagatagtccataagttaaaatggtaataaagttctgatggatttatccttttgcaatttactagttgtattcatccattctcatgttgctacaaataaccacctgagactgggtagttcaggaagaaaagaggtttcattgactcacagtttcacaggcttaacaggaatcatgactgtgaggcttcaggaaacttacaattcgggcagaaaatgaaggggaagcaagcatgtctcaccatagccaagcagaagagagagagagagagagagtgaaatggggcatgccaaacatttttaaaccatcagatcttgtgagaacttactcactatcatgagaaaaacaaggcggatatctgcccccatgttccagtcacctcccaccaggcctctcttgcaacacatggagattacaattcaacatgaaatttgggtggggacacagagccaaaccgtatctttctgccactgggtcctcttaaatctcatgtccttctcacatttcaaaaccaatcatgccttccaaacaatcccccagtgtcttaactcattccaggaataactcaaaagttcaagtccaaggcaaatcccttccacctaggagttacttctaagatacaatggaggtacaggcattgtgcaaatactcccattccaagtgggaggagacatggatctcctttgattccatgtctcacatccaggccacactgatacaagaagtgggctcccaacatcttgggctgctcttcccctgtggctctgcaggatacagccctttggctgctttcataggctggcaatgagtgcctgtggcttttccaggtgcatggtgcgtgctgttggtgggcctagcattctggggtctggaggacagtggtctttttctcacagctccaccaggcagtgccccagtggagactgtatgggtgttccagcctcacatttgccttctgcactgccttaggagaggttttccatgagggctccgcacatgcagcatacttctgcctggacatccaggcgtttccatatgtcatctgaaatccagacagaggttcccaaacttcatctcttgtcttctgcacacctgcaggcccaacaccatgtggaagccaccaagacttgaggcttgcaccctctgaaccaatgatctgagctgtacattggtttcttttagctatggataaaactggagtgctgggatgtagggtgccacgttccaaggctgcacagagcagctggcccttgggcctggcccaggaaacaaatttttacctgctaggcctctgggcctgtgatgggaggggctattgtgaagatctctgacatgccctgaagacatttttctccattgtcttggctgttaacatttggcttctcttcacttatgcaaagttctgcaggtagcttgaatttcttccaagaaaatgggtttttcttttctactatatggtcaggtcacaaatttcccaaacttttatgctctttttcccttttaaacagaagttctaatttcagaccatctctcaggaaggcatatgactgtatgctgttaggagcatccaggtcacatcttgaacgatttgctgcttagaagtttcttccaatagatatcctaaataatctctctcaagttgaaagtttcacagatccctagagcatagcacagtgctgccagtctctttgctaaaatatagcaagagtgacctttgctccagtaaccagtaagttcctcatttccacctgagatgacctcagcctggaattcattatctgcatcactatcacccttttggtggaaacaattaaacaagtatctgggaagttccaaactgtaccacatcttcctttcttcttctgacccctccaaattgctccagcttctgcctgtttcccagttccaaagtcacttccacattttcaggtatctttatagcagtctcccactctgctggtaccaattttctgtattagtttgttctcacactgctataaagatctacctgagactggataatttatgaagaaaagaggtttaattgaatcacagttccacaggcttaacacaaatcatgactggaagatgtcaggaaacttgcaattatagcagaaggtgaaggagaagcacacgtcttaccatggtggagtgcaagagagagagcaagggcgcagttttaaaccatcagaactcatgagaactcactatgatgaaaacaacaagaagaaaatccacacccatgatccagtcacctcccatcagacccattccccaacatggggggattacaatttgacatgagattaaggtggggacacagaaccaaaccatgtcactagtagtgcttggtataagaatattcattaggctgttgagtgttaaagcccagaaatgaggcattagtgggtgaatgttgaaagcgggagctgatgcagtaaatttagcccactcttgctaaaattgtcttggtggagctatagatggaggcagcaaggtataaaacaaatattcatttgtctgcttgtttgtttgaagactagagactttttaaggaattgcttctcttgttattgttaaaccattttgttataaattttatgagatctaatgggaatggtaatatacagcctagaatacgaatttcaaaattataaatataatgattgaatgttatgtatgaacactcagaagaattttgagttttgcccttcatgttaggaaaaggtgtaatttcacaatattcccttcaaagattaaaaagactgggtttagagtattgtattaccaagtggagggataatctttttttttccctttccttttgtgctgctcttccaagatggcattcagaatttgaatttcaccagtggacacttgttgattctaatagtccctttctttttttttttaaattttatttatttattattattatactttaagttttagggtacatgtgcacaatgtgcaggttagttacagatgtatacatgtgccatgctggtgcgctgcacccactaactcgtcatctagcattaggtatatctcccaatgctatccatcccccctccccccaccccacaacagtccccagagtgtgatgttcctcttcctgtgtccatgtgttctcattgttcaattcccacctatgagtcagaatatgtggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccacaataaacatacatgtgcatgtgtctttatagcagcatgatttatagtcctttgggtatatacccagtaatgggattgctgggtcaaatggtatttctagttctagatcctggaggagtcgccacactgacttccacaatggttgaactagtttacagtcccaccaacagtgtaaaagtgttcgtatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttgttttgagaagtgtctgttcatgtccttcacccactttttgatggggttgtttgtttttttcttgtaaatttgtttaagttcattgtacattctggatattaaccctttgtcagatgagtagattgcaaaaatttcctcccattctgtaggttgcctgttcactctgatggtagtttcttttgctgtgaagaagctctttagtttaattagatcccatttgtcaattttgtcttttgttgccattgcttttggtattttagacatgaagtccttgcccatgcctatgtcctgaatggtaatgcctaggttttcttctagggtttttatggttttaggtttatcgtttaagtctttaatccatcttgaattgatttttgtataaggtgtaaggaagggatccagtttcagctttctacatatggctagccagttttcccagcaccatttattaaatagggaatcctttccccattgcttgtttttgtcaggtttgtcaaagatcagatagttgcagatatgtggcattatttctgagggctctgttctgttccattggtctatatctctgttttggtaccagtaccatgctgttttggttactgtagccttgtagtatagtttgaagtcaggtagtgtgatgcctccagctttgttcttttggcttaggattgacttggcgatgcgggctgttttttggttccatatgaactttaaagtagttttttccaattctgtgaagaaagtaattggtagcttgatggggatggcattgaatctgtaaattaccttgggcagtatggccattttcacgctattgattcttcctacccatgagcatggaatgtccttccatttgtttgtatcctcttttatttcatcgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtgtcctgagactttgctaagttgcttatcagcttaaggagattttgggctgagacaatggggttttctagatatagaatcatgtcatctgcaaacagggacaatttgacttcctcttttcctaattgaataccctttatttccttctcctgcctaattgccctggccagaacttccaacactatgttgaataggagtggtgagagaggacatccctgtcttgtgtcagttttcaaagggaatgcttccagtttttgcccattcagtatgatattggctgtgggtttgtcatagatagctcttattattttcaaatacatcccatcaatccctaatttattgagatttttagcatgaagcgttgttgaattttgtcaaaggccttttctgcatctattgagataatcatgtggtttttgtctttggttctgtttatatgctggattacttttattgatttgcatatattgaaccagccttgcatcccagggatgaagcccacttgatcatggtggataagctttttgatgtgctgctggatttggtttgccactattttattgaggatttttgcatcaatgttcatcaaggatattggtctaacattctcttttttggttgtttctctgcccggctttggtatcaggatgatgctggcctcataaaatgagttagggaggattccctctttttctattgattggaatagtttcagaaggaatggtaccagttcctccttgtacctctggtagaattcagctgtgaatccatctggtcctggactttttttggtaggtaagctattgattattgccacaatttcagatcctgttattggtctattcagagattcagcttcttcctggtttagtcttgggagagtgtatgtgtcgaggaatttatctatttcttctagattttctagtttatttgtgtagagttgtttgtagtattctctgatggtagtttgtatttctgtgggatcggtggtgatatcccctttatcattttttattgcgactatttgattcttctctctttttttgtttattagtcttgctagcggtctgtcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgtcagggtgtcaattttggatctttcctgctttgtcttgtgggcatttagtgctataaatttccctctacacactgctttgaatgcgtcccagagattctggtatgttgtgtatttgttctcgttggtttcaaagaacatctttatttctgccttcatttcattatgtacccagtagtcattcaggagcaggttcttcagtttccatggagttgagcggttttgagtgagattcttaatcctgagttctagtttgattgcactgtggtctgagagatagtttgttataatttctgttcttttacatttgctgtggagagctttacttccaagtatgtggtcaattttggaatcggtgtggtgtggtgctgaaaaaatatatattctgttcatttggggtggagagttctgtagatgtctattaggtccacttggtgcagagttgagttcaattccttggtatccttgttgactttctgtctcgttgatctgtctaatgttgacagtggggtgttaaagtctctcattattaatgtgtgggagtctaagtctctttgtaggtcactcaggacttgctttatgaacatgggtgctcctgtattgggtgcatatatatttaggatagttagctcttcttgttgaattgatccctttaccattatttaatggccttctttgtctcttttgatctttgttggtttaaagtatgttttatcagagactaggattgcagcccctgcctttttttgttttccatttgcttggtagatcttcttccatcctttggttttgagcctatgtgtgtctctgcatgtgagatgggtttcctgaatacagcacactgataggtcttgactctttatccagtttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacattttggcatgattttgcagtggctggtaccagttgttcctttccatgtttagtgcttccttcaggagctcttttagggcaggcctggtggtgacaaaatctctcagcatttgcttgtccgcaaagtattttatttctccttcacttatgaagcttagtttggcttgatatgaaattctgggttgaaaattcttttctttaggaatgttgaatattggcccccactctcttctggcttgtagagtttctgcctagagatccgctgttagtctgatgggcttccctttgagggtaacctgacctttctctctggctgcccttaacattttttccttcatttcaactttggtgaatctgacaattatgtgtcttagagttgctcttctcgtggagtatctttgtggcattctctgtatttcctgaatctgaatgttggcctgccttgctaaattggggaaattctcctggataatatcctgcagagtattttccaacttggttccattctccccgtcactttcacgtacaccaatcagtcgtagatttggtcttttcccttagtcccatatttcttggaggctttgctcgtatctttttattcttttttctctaagcttcccttctcacttcatttcattcatttcatcttccatcactaataccctttcttccagttgatcgcgtcggctcctgaggcttctgcactcttcacgtagttctccagccttggttttcagctccatcagctcctttaagcacttctctgtattggttattctagttatacattcttctaaatttttttcaaagttttcaacttctttgcctctgctttgaatgtcctcccatagctcggagaaatttgatcgtctgaagccttcttctctcagcttgtcaaagtcattctccgtccagctttgttccattgctggtgaggaactgcgttcctttggaggaggagagacgctctgctttttagagtttccagtttttctgctctggtttttccccatctttgtggttttatctacttttggtctttgatgatggtgatctacaggtgggtttttggtgtggatgtcctttctgtttgttagttttccttttaacagacacaaccctcagctgcaggtctgttggagtacccggccctgtgaagtgtcagtctgcccctgctggggggtgcctcccagttaggcttctcgggggtcaggggtcagggacccacttgaggaggcagtctgcccgttctcagatctccagctgcgtgctgggagaaccactgctctcttcaaagctgtcagacagggacatttacgtctgcagaggttactgctgtctttttgtttgtctgtgccctgcccccagaggtggagcctacagaggcaggcaggcctccttgagctgtggtgggctccacccagttcagttggagcttcccggctgctttgtttacctaagcaagcctgggcaatggcgggcgcccctcccccagcctcactgccaccttgcagtttgatctcagactgctgtgctatcaatcagcgagactctgtgggcataggaccctctgagccatgtgcgggatataatctcctggtgtgctgttttttaagccctttggaaaagtgcagtattagggtgggagtgacctgattttccaggtgccgtctgtcacccctttctttgactaggaaagggaactccctgaccccttgcacttcctgagtgaggcaatgcctcgccctgcttcggctcgcgcacagtgcgcgcacccactgacctgcacccactgtctggcacttcctattgagatgaacctggtacctcagatggaaatgcagaaatcactggtcttctgcatctctcaccctgggagctgtagactggagctgttcctattcggccatcttctaatagtctctttccagtgctatctctgtgtctagctaagaaaataggtctcttcctagaaaattgcttttaatgaaggagaggtatgaggtaaaagtagggacattttgctgtcaggcagagcttgagttggatgtataaaaaaagagctggaatagtttttcccttattgccactttccatttacatttgttcccaccattcaattattctttttaaaaaggctagaggaagtgatggaaaaactgaagataataaagacacaaaatgctgaggatggatatttgtgaaaatacataatagcaaccaattgtggggcaggagggaagtcagagaacgctggggtctgtctctcctactctgccacagcatttttgaagcagcatttagtaatttctgcacagggggtgccatacttagacaactccttatgatttttcaatttctcattatcttcaagaagtgttccagaaaagaatctagaaggaacactatcaaagataatgggttacagttttccacaatgggtaaatagcctgagttttcagattaaagaatcacactgaatattgagtgatgatgtggtttggctgtgtacccacccaaatctcatcttgaatccccgtgtgttgtgggaggttcctggtgggaagtaattaagttgtgggggcaggtctttccgatgctgttctcatgatagtgaataagtctcacaagatatgatggttttatacaggggagtttccctgcacaagctctcttctcttgtctgccaccatgtgagacatgcctttcactttctgccatgattgtgagtcctccccagccatgtggaactgtgcatgcattaaacctcttacttttgtaaattgcccagtcttgggtatgcctttatcagcagcatgaaaatggactaatagaagtgggatttttacaaattcagttagatgacccagaaatcctcttttgcataaattagttttatctggttttctgccatttcagactttgctaagctagtcttcctgagaaatgtcctaatttttactcaccaattgtctgtggatacctctgttttgcacaccatggtcaattcatattcatttaaatatatttaataatttgatttataatgtgtttcttatgcatttaaatatatttaataatttgatttttaatgtgtatctcttatataataatgattttgagcataataaaatagattactctttctttcttgttccaacatttgattcttgcattagctacaaaaagttagttgagattatttctcagcaatgtagagctactttgctgaaagactgctgtatctttttaaaaacttaatccaaagaaaccaatagatcataagaaataaccaaatataaagtatctgtctaaccaatagacaaacctaattagaatactgcctgcatgcttatgtaagtgttggcattcagaaaacaataccccaaagtatgttgctttggcatgctgagcagtttaaactaaaagagattgaagtcacctcagatataaaatctttctcccatctcctgctctcctgtcttctgctcctctttctccctcaaagaaagtcatagaaaccagagttcctcttatgcaaggtgaggcataaaaactagaacccagtccaggcaggttggctcacacctgtaatcccagaacttggggaggtcaagatgggaagatcactggagactaggagttcaaggctgcagtgagctatgatcacatgactgcactccagcctagataacagagcaagatcctgtctcagaaaagcagaagcagaagcagaagaaggagaaggagaagaagaagaagaagaaggagaagaagaagaggaggaagaagaagaaggaagaagaaggaagaagaaggaagaagaagaagaagaggaaaagaagaagaagaaggaagaagaggaagaagaagaaagaagaagaaggaagaagaagaggaagaagaagaagaagaggaagaggaggaaaaggaagaaggaggaagaagaagtgaaggaagaagaagaggaagaagaaagaaggaagaagaagaaggaagaagaagaagaaggaagaagaagaggaagaagaagaaaaagaaagaagaaagaagaagaagaagaagaagaagaagagaagaaggaagaaagaagaaaagaagaacctgcaactcttctgccccaaagcaagtggtgaaacatagaaaggtcactggtatggtttggctcttttctccacccaaatctcatcttgaattttactcccgtaattcccacatattgtgggagggacccagtgggagataatttgaatcctggtggtggtttcccccatactattcttgtggtagtgaataagtctcataagatctgataggttcatcagggatttttgttttgcatctttctcattttatcttgctgccaccatgtaagaagtgcctttcacctcctgccattattctgagatctccccagccgtctgtaactgtaagtccaattaaacctcttgttctccccattctcagttatgtctttatcagcaacatgaaaacggactaatacagtcactttctccattttcttgtctcccttgaggatcctcattccggaggggtcctgccccatacctgggaggaaggagtgctatacagagaggccaagatgaatctgaagagaggcctcactgagtccttcttcagtcgatcaccgttagaccaatcccttttgttcaatcatatttctgtctttcttttttttttttttttaaatcaagacagagtttcgctcttgtcgcccaggctggagtgcagtggcacaatcttgcctcactgcaacctctgcctcctgggttcaaacaattctcctgccccagcctcctgagtagctgggattacaggcgcccgccaccatgctcggctaattttttgtgtttttagtagagctggggttttaccatgttggccaggctgttcttgaactcctgacatcaggtaatcctcctgcctcagcttcccaaagtgctgggattataagcatgaaccaccacgcccagcctgtttaatcagatttctatagagctgtccattcttcactaaaccaaagcataaatgcaatttttcctgagtctttgagtttttatttctgacagcttccctgtcacataaaactttgatttgaaaaatttggtaagcttttatcttcctaatctgtcttttgctataagagtatgactgtgattcttatcatgggtgaggaaaggtatcacatctttccactcctacataaggtatgatatacattttcctctttggtaaacaaaatttccgaaagacaagcaaatggactgtaatgatattctatgactataccacttgggagcaaagttggccatataggaaaggctgaatattaggatttattaaatttatttttaagtgttttaattctgtggaataattggtgtttaggcaatttatataccttatattaatcactcataaatctcctagaaaattaattttattagacaaactttataaaggaggaaagagtaattaaaatactattaatgaaaaggatcaagtgaacaagataagcaaactttgtttcctctgccccaagtcaaactaaaatattctgtgttataaaaagagtataggggagggaaaattttctttatcttgtatccatattaggttcatcagggctctagacagagaaaaggcagattaacaagagaaaaataaacagaactttattgacacatgcatcactcttacctgtgagagcactcagtgatgcgagcactcagtgatgagtgatgatggttagaacctaagcttataaagcatcttagcaaaacaatcattgttgtgtagggaaatgacaagacaaaagaaaaggattttgagcttctaggggcagcatgttgtgggaaggcaaatatgtaaggaaactaaccatagataatggtcagttaataaagtttcttttgttgattcctctgctgctatctcaagttgataagggtctaaagttgtctcaagagattagcttctatccttcctggtagagagaggaggggggcgctgttacacatctgtctcttctttggcaaagaggaaggacagaggttttccttaaatatgctgcttctcaatttcattcctctcacaataatccttatgccaaagtggcatatttcgggggtgacatatattgttaccctttaataaattcatgctgcaatatgtttataataatcagtacatatttgttcattactttttaagtactcagtaaaaaaaaaaaaaactgtaagaatattaaaatatgaagggcaaaatgcctccctttaaagagtgctaaattcagctgtggagctaaacatatatatcttaagatatgtcagtatgtatctttcttttccgttttgaatgaaaaatttcaacatatgatgaagtagagagggatgagatgagatctctgcaggtcctgggtctgtggtgcttatgaacattttcctcctttgcctggcccttctgtgctctgaggagggggaggctgaccccttcacctgtgtttttcagcaccacccccacacttgtttctagcaatagaaggctccaatggagatgggggtgagggggcaagagaatccttagcgtgtttctccctctgtttcagagcttttagcttcaaacaacatgttaacatctggccttagttgctacaacaacttatttttagttttagttttcctttaacaattgaaaagaaattacagagatttactataaatttctcagtaggcatctggaaaaaaattaagatattgtcctcataaccaaactattattatcatatcaaagcaaagtagcaggatttcctttgaactctgttttagttttttaaaattcctaactctcctacaattctgtttataattgatatatttgaatcccagtctaaagaaagtaaagatcccagtcacattgaagtatattttatgcaattggtacattcttattttaaaataatgttattgtttatctgaaattcaaacttaattgggtatgtaatgtttttattcattagatttaggagtcatagccatgtttcacttggttattgtgcttttataggtcataggtaaaatacaagccctgggtcagtggctaaaggtaaatatgatgagctaatgaagctcacattataatttactggagctcacgttataattgatggtaataaacaggcaatacacaattaaatcaacaatatgttgataagtgctgtaaacagagaaaaaaaagtagatgtgacaatggtaaatgtgcactgggaggtcagggacaacttctctggtgaccaagtgacattgccctgacagctaacttacagaaagcacctacacatgtgcaaatattatgcttcaccttcaaaggttaaaaaatatatatgacgtaaagtttctatgaaagccaaattataggtcacatcactttttcattctcagaagaagcgattgaaaatgtaaaccccgtgaggtgggaatgcatgtagtctactcagcaaatgtaaaaaactgaatataagattttgatttgtagggtatcttgagtaaactagaagggtattttgagataaagtcaaagaggtagataggtgccatgttatttaaaggcttttatgacataaggtggaaattggattttattctacgcgtgctgagaagcttaaatataggagaattagatgaaactgattcctcttgcaggagagccacctggctgcagaagattgtcagagatcaagggtaggagccttgggctggttagcagggcatgattatagtaagtcaggtgagagatgtaggtggttcccaccagagttgtagcagtggagatagaagagggatggatttggaatgctgcttggacaaatacttcctggccctctagggtgattcaactagctctgcttgctttttctttatatttgcaaaagaattgtgagtgaacttgtatcacaacatctaaaatgctatattaactttcctgattatgttgtttttttctcctactagactataaaccccttgatgacaaaaatagtgtgcatttcacagcatcttgctcatattcagtgctcagtgcattctggagaggaagtaatttaatgagattttagtttacattccacaaagaatttccaatgaatgtggcttctacaatcctgttaattaaaaggattgcaacaatagtccaaaaaatacacatgatatgtaatctggctattatagaaactttaaacgctattcttttaactttgaaggttaagcttggttcaagagctgcctggaatcacagcaaaagtaataaaacacacaagtttttagcctctttaagggaaaatacatataacttctccaactttcctttaccaaatcatatgactgatattgaactattcttttctcctttgctgcttttgcaatcaaaaccactcccattatcttggtaaagaatgtattctatgattccttgactcctataagcttaatgacatcagcttttaaaatgttgacagaacaaacaaagtgcacacagctgcaacattccctctgcctgcagttaggtgcttttatgcttttactaaacacacacacacacaaacacacacacacacacacacactcatactcattctacttcatttcaatttgaactacatgtggcttactacgtctcagttaatggcaagcaacataacttgttggcttttataaaagttaattattacttgtatattaatttgtttaattttgtttgcccctaaacactctgagaaggaatcattgctattttgttagattttctgctacctctcacatgagcctgatacttggatttccattttttaatgaataagtaaccgatgtaatgaactaaataataaccttgttgaacctaatgttatgaagtcaagtgtgtttgtcacccaaagaattttaagtggctggatggtgagaagagtcccgttagagtaatgcccatgaattataacacccactagcagcaaaacaacacgtgcattctagagtggctcaacctaatgcgtgaggcatttgggaaactcttgagaacatactcacaaaagagtagtattcagtttatgattatttatcttagagcctctttgtgattacttatttggtaaatatatcaatttatagaattattcaacctggcttctctataattattaattcattatttagcattcccatttgttgtaaaatactctctactcttccctgaaactgagttattacgttaaggctcattgatattttattcctcataggcaggatcgtgagggcattaggaagaacttgggtatttctttgttagagatggacaaagtagttctatatacaacaaggttatttgctggacccagccctacattacattgtatgatttttgcctcgtcagctcttattacagtgactatccccttgtagagagatactcaagtattatttgttgtaacttgaatgaagaaacagcacttgagttggaaataggaaaaaggcaactcttcacagtttgtgtttatgtgcccagaaatgcttgttgactacacacaaacaccatgctgaaatataatcatccaacgaaataaagctaagctgagataattaccactgggatatttttagtcaataataattatatgttaaccaactggtattttctgccaaacgagagatggcatttctgttgatgacacgttgcatgtgttctttctacagctgtatcttcatgagtcaacaggctttctctaagtctctctgcaataggaattaacaatcagaccatcttgctcttttttttattgccctttttgctccacttgatgtaaacagggatactggccatttcttaaatgatttttatttttctactatttttctcagcataccaattttcccttcaatactcaagtttaacgttgagagagaaatgaattttgcccccctcaaagcctctgtttacatttagttaatgagataatttgtttaaaggctaaataccattactcatatgctaaagtttcacaccatgtagaaagtttatagaaacacattaaactgaatgccaaaactatctagacctcactaaaaattgggatctatgtgcctcattttagtgaagaagtttgaattaagagagatcacatcactctctctgacatccagggtgaagtctcagcattatggactccatcctcaccgtcatcttgtactagttaacttttccctaactggtaacctacacataagaatattgcactttttcattatgactgacagagatcctagtattggtgtatggagactattagataaaaatcttggcattaaaagcaggagaaggaatatggaaaaatgcagagctgtcaagaaggctaatgcatataggttttaagaaccacatgaaggtactacttttggaacacagtggaaatcaaatgcatgacttatcaacataatcatttttggatagtatgcactacttgaacatatttaactaatccaaagtcttccaaggcttggatatacactggtagaatgatgattaacaacaggacttatatctgtgctttcttatgactccaataaatatgaagtccttactactggacactgattgtgtaagcagtatagcacccatagagagtgatcacaatctgagatcattctatcttatggtagctaaaacagtgcacattcaaggatatatgagaatacactgagtaaataccagatgtagaaggaaaggattttgaagtagtatgtgaaatggctcacagcacatgagttggtgtcagacgaatctggatttgagacctgggtcctcatctgaataactctataatcgtcatcagctaagttctttaaagtacagtttccaaatttatacatctgaggtaccaatatccataacataaatataaaataaaaaagatgtttataatagtgttattttagcacatataaataagcatttattataattataaatatataaataatttgtccaagattcatttcattaaactgagaagagaaataacatattaaaaatatttatcccatttctccaaatcaatgggagaaaagtacaagatgagttgtgggggtggatagatgaggaaaagacaatgtctttacggtatttccagttcacttctttgtttgccttgctcagtgtaagtagatcttggggaattaaagagtcagctgatatgatgatttgtttgttaccagaacctcagcattctaaggagatatactattgacctagaagactggggcctgtgttctctcagtaaccacttgtattttccaggacaaataagttctcatcttctcatctgtataataaagagttggttcttatggtcattaaggtcccttttaggcacaactatttgctgatataataacgtcatcttcaatttacttattctctgttgtcgatgggaaatcaattcaaagtctcgtatttttatgctttttttttgattattttgttttcttccccccgcaaagcctgaaattaactggcacagctgtggaattagtaaaacctactgaggctctagtcgttggtgacctttagttttaataagctgtgctgggttttattgtctataactagtttcttttaagtagatatgttcactttgatatcatattaatagaaaactctctaaaatatcagccttaacataaattgttgaactgcattttagagttcttactttttcattttttaattcttatatttcacaaataaagatgtatgctttcattaaaacgtgtatacataattacactcatcctcttaatatcacatatatataactaatatttttaagagcataagtggaaaacatgcaaaaccaagtgaatataatttatataggatattatcttcacaataatattggattcaggacagatgattagatgagcaagatattatagtttatagatcggactgtatttaatatagtttgtattttaatttcagtgtctgtgatttaaattacaatgaattttttaaaattgcatataaatgcattgttttagacagattaattctttatattcatagtcatcattaaatgagtttttcagtatggtgaaaacattattttttctttctatgaagatctttgtgtaaagatttccttcagttttatttgaaagaatccattaccttcaaaatagtcatattattttttctttgccagtataagaaactaaagttattgttatgatttgcatatttatattgaattttcctttgtcatttatattatttctatttatttaaaaagtatatgtgaataggctgggtgcggtggctcatacctctaatcccagcacattgggaggctgaggtgggcagttcgcttgaggccaggagtttgagaccagcctggccaacatggtgaaactgcatctctactaagattacaaaaattagctggacatggtagtgcgtgcttgtgatcccagctgctcgggaggctgaggcatgagaatcgcttgaacccaagaggtggaggttgcaattagcggagattgtgccactgcactcaagcctgggtgacagaggaagactgtctcaaaaaaaaaaaaaaatctatatgtgaatagataagattaaataaaatatatctaatgctaataaatgaaactggtaaaaattgaacagcttatcaaagtctgaatgaccatcgaatgttttagtggtagactagaaactgaagccaccttccacttctgcagaaccatgacaaactgggatagaacccatggtcttttagcctttgaattccagttgctcttagaagttccatatcaggataaattgaggtatgaggagaaaggattgtattaaattcattaagggccaatacagttttctggctctgggaaccattgtgtattctcagagaagaagagagagagcattggaacttgttactttctctactacacagctcatagaaggcagaaatttatttgtttttgcataactacagaactcattaaagaggtagatcaaattttcagacttgatctgtctagggtggtttctaggagtggcaaattataagctggtataccaagcatgaattggagttggctaggccaagtaagggatggtgatacattagggtacttggacagatgaaatagcacatatggaggtccatagatgaaacaatgaagtgtaatctaggacctgaaagaactttgtagttagttgaatgtatacattgaggtcattatataggggagatgaagattggtgccatgaagtgagataaaaattatgcagagattgaattatgcagtttcatcagagattggaaaattatgcagagattgaattatgccgttcatcaaatatataaagaaatttggaatcgattctaaaaactaggaggatacaacaaagtgttttaagtgagactgatgtaatcagattttcatttttttaaacttggatttgaaactagtagagccttagtgtcttagatcctcttaacaatgaaggacaacagtttattcacagacattttaaataagaatgcagatccccaaagaattgaaatgacttacatcacattcctcctaaaaatgtcagtaaaaagattgataaagcccaggtttctgttcttggaggtattcttttgagaatgtgagagatgttaaaattcttttttttaattagaaaatcacattctattataggctgctacatgtaatcaacctcaccaaaaaaaaaaaaaagaaaaaaaaagaaagggaaagcattactgaatgctacctgtcccaaacattagtgaaactgatggataacattttttaaaagtatttatcccagcataatacaattttctattatgagagcgaggtatagaattaaagcaactatcaaaatagcccatatcagatgcaatctttaccctgaataacaagactattaaaggataggagtctaaccaaagggacttttaaaagtgtctgtcatttgctgatggtggcacagattttattactctacaggtcagagggccacgtatttctctgtttatagtgaggtgggttttttttaatagtacatttatctttcttgaatatgggaaatccatacatagttactgtgttagaattcctcactaagaataattctcgataatcaacgctatcaggagttgagggtggcataagagagttcaagaataagatgataatttgatgatggaaaaataagtgagttctcctaatgcatacctcctatcattgtagacaaaagtttatgttctcaaagctgttttcacgtactacactcttcacctctatgtgatttgtttgctagagctgctgtaagaaaattccagagactgggtggcttaaatgaatgaaatgtattttctcatggtctgggtcccggaagtttatgatcagggtgctggcagcactggtgccctctgagcctgtcttcttggcttgcagacccccactcttctgcctctccccatggtcctgcctccgtgcatgtgcaccccagtatctctttttacgtgtataaatttcctcttcttataaggatgccagtcagactggattaatttccaccctaatgacctaattttaacttaatttctctttaaagattctgtctccaaacacagttacattttgaggcagtaggtttagagctttgacatgtgggtttcagaaggacacagttcatcccataataacctccaaagacgtcaatgctaaacagcctccatgagcttattaccaactcaaaaacatcgctttcttcccaggccttccctgtttgttttacttgactgattaatgtatgctgctctttgaagctcagtttctttctccagtgaagacctactgttttcccaccttcttctctaactcctactttgcactggtttacaactcagctcacaatattcccaagttactttatcagtaaaatgttttcaatagatgaaactcatagcaagtcaatacaccattttccacttaaatttgcattattttacattggattctaattgatccatacagctcgattgtctccccatctagtttgcagttgatgagaatgggaatgacacattatatttattttgtatcttcatatgtgttgctgtacatactatatacaatgatagagtgctgtgtatatattatattctcaaatgattcaatttgattcaatttctgatagtgaaatacccagctacctgattctgctggttttcaatgttactttaattggcgtgaatttccagcaattagctttccttcaccatacatactttataaccctctagactgctcaagttggctgggcctggtcttcctgacccagaccattggatgtttaagatcacattccaggcatgaggatggctgcacatctattacctcacagattgtcaagcttgattattactgatgtggatgattatctaggtgtccttatacctcagtgttccccctgtgccttttcaagaagagtattttacccagtacagaacttttttagaaatcaaggttatacaagcaactgtgctcatttgtgatcatcttgaaatccgtaaatactgtccgagtatattactatgttaggtgaaagatttgtgttgctctccacaaattatcaatgtttgtttacagaacatttgtgaaaaataatgtttggaaatgacttgctacgtgaagtaagtaaccagtaactcaagccatttctcccatgtggtctgttttaaaaatggaaattctgtaatctggcttcctcaccttggagtaatatacaaaatgtcaaaatgagaaaagggaccttggtagttgttgtgtctttcttgtttattctttcttgttaaatactcaaagaaagaaaaacagcatgcaatgtttgtagctcccattgtgttagctttttactgtcctgacatatgtcctaaagtttaaaaagcaataaaaggttgctgcttccacagtcattagctttcgttgctgcagtcaatcatccacagaggtcagagccgtatcagtttttcccatcctcattgcacaatccactctagccattgcactcatatatcattaaaggaaaaacgaaccaaggaaactaccgagactcaaaaatgaacttgcaatgtgaaaaatctcctatctccttatttgaggaaagatgctcctgtcacgctgagtaaacaataaaattataaggccaacactgtaaatggaagtattatcccatctattgatttataatgggttaattaattttcaagtgttcttatttgcaaaacatgatgtgaacattgacagaaatccttagatagtttaagatgaagtcacttttgtcttagtgacttgatcacttatacttaggccatagttaagaatctaataggattatttcagcagagtgttgccagattcatgtataaagtcaagaagtaaaagaaaaatataagttagtcatgtttgagttgggtgatgtaacctggaaacaaatctgactggactaataataacaagttaataaactcactgtgaacaaatcaattaaaaacctaggcattgttatatttatttgcatcttactgtctaactagactttagttgaaccacacttcatttcattttaattcaagcactcattgataatatattttgcatttcttagataatttcaaaaaaagatagtgtgccatagtcatattattataagggactagagttatattctaagtcttctgacattcaataaaattgttataattgggttagacatatatgaattacaaaacatgggtttgaaagtggtcacccaagcatgattaggaaaactgcatacaagtagtcttactaaatacaagttgtaccactccttgcttcatccctcagaaagaggcatgatgttgtcactgctgctcatcttcagcttccactttagtttctgactaattctgccctagcattttcttcctgtgcttttggctgtgattttccggttacttgaatttcttgtctgccttctttgagctagaattttcaggtttagtgtttgtattgttctgactttgtgtttgggaagactgctgccacaagtatgtcccggtgtatgtaattatattcttgaccaatgctccttgtctctgtccacataacctctgttgaatcccaaatgtgtacccttggcaagttgctgggtttagtgtgagagtcgatacggcaacatcacatagaaaaaatgttcacggccaatttctaatttgataatgtgatgaaatttatggatgctttcctcattaagatgttcatcacacaaacagctgcatataatttaaagacatattcatgcatatgaacttaaaaactcatggtttagaggtgtttttaatgcatttccctggagtttttcattgtatatgacttttttttttttccttcttttgtcccttggttatattaagctgcctcttaatacttagaaaagcagtgcttaagaaattggaatatctctttccataaatatgtgataaaatgtattgtaacttatatgatttattaaattgagtcacgcctgaagcaaatgcattattaagtagttaaaaaattcatgacatgtccttaacacactgagagtgccttagaggagttcattcatctgataaatatgtgtttaagaaaattgcttgaaatgaatctcttttatgagttttggtaattattgttcttatttaagacttagatatatatagcataaataacagaatgtgtttttcacatagggttgtggtttgtttttgaatgcaaatagtcagtcttttcttggtgggtatataataaaatgctttttttgcatcattaaaagttctcaatagtctatggtgtcctagaacatattatctacattgtatataactatgtttctgttttgagatttaaaggaacatatgcaatagcaactttatatgagatttgatttttcatatcagacttcagcctcaagcatttagttgaagaatgaagatcttaaattttgacttttctgtttttagccagacatgttcaaaataaaagtgctatttaaaaagaggtctgtttccatgtcatctgaaatagggatgttttaatttatgttatagtttgagatacaccaaatcaaaggaacaagcctgcctcaataacccagtataattttcctatggctgctgtcacatagagagcacacttttttttaagttacagctttccatccctttagcacttaatcatgtagagatttgtatcgttgattatgcataaaataatttgactaaatactctgaggcagtgtcggtgacattttgttgctgttggtaccacctcttgtttcattgctactactattagtaccatcatctttgataattactacaatttactgagtgctcgcattgtttctaacatgaagaaaagggctttattttaactatgttgcagataagaaactgagatctagtgattttaaataacacacacaaaagagaagtattgggtggataattatttctgtttctttttgtaatccatgtatgcaattcaacaacacacaataataatagtataaactatgatcaaaactcttgataggctttttataatgcgatcggacaacactatttaactttctcatttattatttatctaaactatttgaataatttcaaaatattctctgcttttcaggctacttgatttgcagcccaaataatctcaaaattgtaataagtcaaggaacatttttagcccgaattattaaaaaattgctttaattttgctttagaatcaactcctcactacccattgcattttagttttatgcgtttctttatcttctattgatggactttgtaatatattaatttatatgcttaaagtcccatttagctatagttttccttttgatttaaatgtaacttaaagagaggaaggaaaatttttatttcatcacaacttcttccaagtattttataaaaattctgatggttctctttactgaacttcttctaagtgtttcataaaaattctaatggttctctttactggcttgtattagcttgtactttctttgctgtaaggaaatatatgagatggggtcatttataaagaaaaaaaggtttaattggctcatggttctgcaggctgtacaggaagcatagcagcttctgcttctggggaggtctcatgaagcctccaatcatgatggaaggtaaaaacagagcaggacgtctcatatggctggagcaggagcaagagacggggaggggtgctacacacttttaaatgatatctcatggtaaatcactcattcactatcatgagaacagcaccaagaagatggtgctaagtcattcatgaagcaccacccccatgatccaatcacttcccaccacacgccgcctccagcactgggattacaatttgacatgagatttgggcaggaacacagatccaaaccatgtcatggctgaatttaccaaatcaactgtgaatggaaagaagtgaatgaatgctagcaagtaaatgtatttcagattaaatttttttagggaactagaagtaaattgccctgtttaaaaaatgaatttataatggacttctagctttggcagcatgaagatgttgtcacattctctccaaaaagcaagtacagatgcttctagacttacaatcatgatatctacccataagtaaaaaaaaaaaaaatcttcagttcaaatatgtttaatacccttatacccaccataatatcaaaagttgtaggttgagagactgtaagtccagatgcttcctgacttacgataggattacattcagataaacccactgtagagtgaaaatgtgtatgttgaaccctagtaactcagggaccatctgtgtgatattggaaaaaaatagaaacaacatttcaaggcacatatgtcaacaaaaagcagaaaacgagttaataaaatttacttttgaaataaatgcaagagttgcaagttagaggagtatctgtggccttctttccaggtcgctgccatcttcactccccacgtcaatagagtcagcaagaatagtatttgtaacagcgggcattgaaaaccaacagtttcgaggctatgcatggggaacttcctcagtttggagtagcaagtgaaaacctatggctttgccagctaaaagtgagtacttaggtgggaacaactgagcaaaacatttgtgttagcacacagaggtcctggttgggggagcaatggaccagcaagaaagttagccaagagattctgaaaatgagcgagccatagaaggtctgagataaggtctcgcatatcactggctattagggaggcctgagagggatttgagaaacagaagctgaggaagacttgaggactcacttcaactttaagtgtgttttccaaaccactcactaataaatgtgaagtgggtagacaccttatggaaacaaagcctttgagtacatcctctatccaaataactgggtgatcactaaactatgaagacatgctggagggccaggctcattcctataatccctgagctttgggaggccaaactgggaggatcatttgaggccaggagtttgagaccagcctgggtaacatagagaagtctttccctgcaaaaacatttttttaaaatgtatctgggctagtggtgtgtgcctgtagtcctaattacttgggaggttgaagtgggaaggtcacttgagctcaggaatttgagattacggtgagctgtgatcaagctatcacactccagtccgggcgacattgtgacaccctgcctgtaaaaataaatgaatagataaatagacgcagggcagtattcctagaaaacaaggcataaaaatacaatagtaatggtaaaatacaattaagtagagtatcagtggctgggctacacatcaaagctaattttaacacacatacacagaaatataaactgcattccagagttggtatgatgcattttctaatatattaaattttcaaccacaaattatgtgatatccgaagaaacatgaaagtgtgaccaatactcaaaagagtattgagtcaatagatattgacactacatgggaccagatattggatttagcagaaaaaaaaaaattcaaaacatctactataaatattttcaaaatattgaaggagtgacatcagcaaaatggcggagtaggattcttgggcttcactctccctatagaaatccaatagcaacacaggaagtataccatcctaaatgtcccagaactcaggagtgaggctaagacttcccttggacccttggacttcaggacaaagaaaaatggaaatcaaatattaagacttcagatgtttcacctcgttgccctttctctaggccaacacagtaccatacacagagaattctcctggacccacagtttctacagttgggaaagttagttggaagcaaatcttcagttttcccaccattcaggcactctttacagaaggctcattcctattttgtcccacaggaaacattgggattacaagcaggggtggaccacctggggtcagttggcaaaaaagagcatttaggagcagctttaaaaaagaatagacaaacctttaactagacttactaattacaaaagagaggttattcagtaaacaaatcagaaatgcaaggcgaggcatcacaatttacaccactaaaatacgaagaatcataagaaactattattaacaattacacaccagtacattggataacttagaagaaatggataaattcctagacacatgaaagctttgaaaacaaacacaaagaaatagaaaactcaatagagcaataatgaacacagagactgaatcagtttaaaaaaaaaaaaaagtcttccactgaggaaaagcgcaggactggacggcttcactgctacattctactaaacatttaaagaagagataataccaattctcaaaccattcaaaaaaactgaagtataaacaatgcttccaaactcattttatatcccaaactcattaccacaacaccaaaggcagacaaggacactacaaggaaaaaaaaaaaaatatatatatatatatatatatgtgtgtgtgtgtgtgtatatatatatgtatatatatgtgtgtatatatatatgtatatatatatgtgtgtgtgtatatatatatatatgtatatatatatggcaacatcattgataaagatacattttttaaatcctcaacgaaactattagcaaacccagttcaagaacacattaaaagaatcatttttcacaatcaagtgagagttattcttaggatgcaaagatggttcaaaatatgcagatcaataaatgtgatgcaccactttaacaaaatgaaaaaaaatgagaagatgcagaaaaagcatttaagaaaactcagcacccttttcttataaaaattctcaacaattaactatacggaaaaaatgtacttcagcacaatatatgacaaacacatagctagtattattcttaacagtggctagttgaaagcatttcctgtaagatcagggacaagacaacgatgctcactgtcactacttctctctttctttctttccttcttttttttttttttttttttttttttttttttttttgatacagagtctcactctgttgcccaggctggaattcagtggcataatctcagcttactgcaacctccgcctcccaggttccagcgattctcctgcctcagcctccagagtagctgggactacaggcacctgccataacacccagctaatttttgtattttcagtagagatagggtttcactgtgttgcccattctggcctctaactcctaacctcaagtgatccatccacctgcttcagcctcccaaagtgctgagattataggcatgagccaccgtgcctggccacaccacttctctttgataaagtactagaaatcagagccagagcagttaggcaataaaacaaaataaaaggcatactaataggagagaaaaaagtgaaattgtttctctttgttgataagatgatcttatgtgtaaaacaccttaaagacatcataaaaaaactattagaactgatcaatgaatgcactagagttgcaacattcaaaattaatgtgcaaaaatcagtagcttttctatattgcaataatggtctatcttaaaaggaaattttttaaaaaatctcatttacaatagcaataaaaaagttaaatatataggtgtaaatttaactgtaaaatacctgagtattagaccattcccacattgctataaaaatatattagactaggtaatttataaagaaaagaggtttaatgggttcacgcttctacaggctgtacgtaaagcatgatgctggcatctgcttgcttttggggaggcctcagaaaacttacaatcatggtggaaggcaaagggggagcaagaatgtcacatgatcaaagcagcagaagtgggaggtaccacatacttttaaatgaccacatctcataaaaacactcactattgcaaggacagtataaacaggatggtcctactcatgagaaatctgttcccataattcaatcacctctaaccaggccccatctccaacactggggactacagttcaacaggagatttaggtggggacaacatccaaactatatcaacttatatactgaaaactataaacattgaggaaagaaattcagggtaatacaaatcaatggaaagatatgccatgttcatggattagaaaaattgatattgtgaaaatgtttatgctacctgtcttcatctgttctgtgttgctattataggatacctgagactgggtaatctattttaaaaaaaaagacgtttattttggctcagcattgtggaggctggaaagtgcaacattgggaagccacatttgatcagcatctgatgagggccttttacttcatcatgacatggaagagaaatggaaggggaaggaggcacacaaaagaaaggccaaattggagaggcaacttcactttataacaatccattctttcaagaattattccattcctaaaataatcaacccaatctcaaaagacatgaatccatcttaatgacctattttccttttaaaggcagtacctcccaacagtgccacattggggaacatggttcaacatgagttttggtagaaataaaccacattcaaatcacagcattctatccctggctccccctataactcatgtactcacaatgaaaaatgttttcaacccatttcaatagtacccaaatcttaacttattctagcactaaggcaaaagtctaaagtccaaagcttcatctgggactcaaggcaaagtccttccagctataagcctgtaaaataaaaaataaatgtattttctaaatacaatggtggaacaggcataagatgagtattctccttccaaaagggagagagaggcaaaaagaaaaatcagcccaaagtaagcctgaagcccagcagggtagacattaaatcttaaagctcagaatattcttgtacttcatgtaccttttcctgggcacactggggtagaggaggggcttcaagacctcggacaggcccacctccaagactttgctgggtgtagcccgtgtggctactgtcatggattggggttgcatgctggtgcctgcagatttcctaggctggtgtcgcatgttgctgatgacttctgtgggtctggagtccagagggaagtggccctgctcccatggttccactgggcattctagagaagactctctgtgctgactctgccactgtgacagatttctgcctgagctcctaggcagtttgacaaaaactttgaaatctagttggaggctgctgcacctcctccactcttgcattctgcctgcatgcggaattagcaccatatggatgtggatattgccaaggcttacgacttttgccttttgaagctgcggcatgagctgtacctgggatcccttgaaccatggctggaacagccagagcagctgggatgcatggagcagagaatcctgaggagtgtgcttgaggcctatcccccacaacattccacccttggagacctctgggcctaagataggagaaacagcctggaagatctttgaaatgcctttggggtctttttcccactgtcctgataaatggcctctggctttgttctcttcacactaatctatttagtgaagagttgctgtaccgcacccttggcttttcttctgaaaacagttttattctctaccacatggtcaagcaataaattgaccaaatcttttcactctacttcccttctttctagcagttcactagcagttagaagtaaccaggcagcagcctgaacatttgctgcttagatatgtctacaaagccctaggacagggacacaatatgatcaagttctctgctaatgtctaacaaagatggcctttacaccagttcccagtaagatagtcctatttccatctgaggtctcatctgaatggcttttactgttaatatttctgtcagcattctggtcatgacaactgaaccaatctctaagaagttttaaacatttttttagtcttttttgtcttcttttgagccctcattatattatccttaatgctccacatacagaaatactatttataatagaatattattctacttaaatgataggtaagggaggtgatggatatggtaactaacttgtttaaaagagaaagatatgactatgtgctgtctataagagatgagactaactttagattgaaatataaaaataggttataagtaacttgatttaaaaatctgtaccatacaaacataaccataagagagttagagaggctatattaaaatcagacaaaaacatattttaaactaaggtatattactagttataaagagggatcttttaattaaaaaaaggtcaacacggaaggaaaagataacaattataaaggtacttaacactagagctttacaatatatgaagtaaaatctgacaaaattgaaaaaacagaaatggacatttcaacaaatataattgtgatttcaacacccttttcttaattgatagagaaagaacagactaaataagtaaagatacaacaaacatgaaaaatactattgttgtagaaaaaaccgggttcttgtcacacgaccagaaaatattaggcatgcagacactttgaagagtgacggggagtggaatttattggatgaaaataaaaaaaaccctgtcagcaaagcgagaggggttcctgttaacaggtctcaacctcacagatcgaatcccaggtcaccacccaggaacagaagaggccaggctccttcgccctggaaacagggcgaacttcctgagcctctaccctgtctctgcagtgcgcaggtgggcattattcagaaataatcagtcaggaaaagggaaggcttcatctgggacaggcagcctggtttctcagccttcaggctgtttcagccttcagcctcaggcggggttttgccaggggacccttggctgcctcctgtctctatcattccccctcgaaaggagcacatctaactgcccttagaataaggataaggataaacacgaagaccaatcttaactgcttcctgaagacagagggggctgctttggggaaatggcagtcagatctccctcagaggccaatctaagcgttcctggcaaaaggggccattgtccaaggctctgtttgcatgaccatttggagtctgctggcctgaaggagagaagggacaaaccaggttattagaaaacatgtatccaaatgaaacaaggggtgggtgaggacagctcaaaaacccgaggtcttttacgggtgtgtacatggagagggaggctgaaagcccactggaaaaaaaaaaatacttttacctttttgccagcgtgttaggcttctgggtccccttcccctgagcccagtcctaagccaaccagtttaaggtttgtgaaattaactcttcccagtttggaggatgcatatgacgggagcgtcccagagtatggacacacaattacctatcagtgaagagaggacagaggaggaaaaaggaaaaaaaaagtagtcattttttttcaaaggattcctagggatttaggatgcattcaaaaggggtacagactgaagatgaatggctactcatctagaatgaggagagcaagcgtccctgattcctttctctttctagcaaatacatgcggtacgtgagggagggaaaatgaagcattcctctttctttcccccattcttgtatctcccagtctcggtgaccacgacagggtgccatccatgggtgttaaagtggctttcaaccatgttcacaaggggacttaggtgataggagtatctgctcttacccacatatgccccatctcccctgctgtcagtaaactttgacaggaacaggaactttcccaggaacaggagaggccaggctcctccgccctgcaaatggtacagacttcctgaggctccaccccaatctcccagtgcgcaggcgggcattattcagaaagaatcagctgggaaaagggcaggcttcatctgggatgggcagcccagtttttcagccttcaggctgttttagtcttgaaggtgggcttttgctgggggacctttggctgcctcctgtctctgtcactatcaaccaactggatctagttgacatctataaaatattttacacaactgtaaaatatacattactttcaggcatacgtgtaacactctcaaagggaccatatgctaagcattaacaaatgtctcaatatacatgaaaggactgaaatcatataaagtatattctctgatcccaatacaattctattaggaatcaacaacaaaatgaatagttggaacatcttcaaaatttgaaaattaatcataaagttataagcccattggtctaagacaaccttttgagagatattaaaaaaatcatatgaataaagatggaaacacaaaattgaaaagctgatggaatgtgggtaagctagtgcttagtgagaactatagcttttagccttaattttaaaaaacataaaaaatttaatgttaagaatgtaagattctctccaaaaaactaaagacacacagatcaaatccaaagtaattagaagtaaataaatagtagatctctgagtgaaaagaatgaaaaagaaagtagaaaaggagaaaaacagtaactaaaatttgtccatttttaaagataaaggaaggaaaacaaaaaaaaatactgatagacttttaattagattgaccaagaaataatgagagaagaaacaaattatcaaattgggaatgtgaaaggattctcactatagaaactgtagaaatttataatgtaggactataaacggaacattatgaactactttattccaataactgtgaaaaacctaggtgaaatggataaatttgtgaaagacacaaattaccaaaacaaactcaacaaaaacagaaaatagtgagatctatatcaaaaaaatgaattattaggagacaaatgtgtaaaactgacaaaatttttgaagtcactttactaaagatcacatatgaacagcatatacaaatggccaacaaaagtgaaaattgcccaacatcactaatgattagggaaatgcaaagcaaaaccacatgcgataccaacttacttctgcaagaatgaccataatttaaaaattaaaaaataatagacattggcatagatcttgtgaatcaggaacgcttttacactgctagtggaaatgtaaactactataaccactacggaaaacagtatagagattctttaaagaactaaaaatagatctaccatttgatccagcaatcccactattgcatatctatcaagaggaaaaaccgtcattaaatgaaaaacacacatgcatgcacatgtttatagcagcacaatttgcaattgcaaaaatgtggaaccaccctaaatgtccttcgaccaacaagtggataaagaaatgtggtatgtgtatataccatggaatactactaagccataaaaagaaacaaaataataacattcacagcaacctggatggaaatgaagaccactattctaagtgaagtaactcgggattggaaaactcaacatcgtgtgttctcacatataagcaggagctaatctatgaggatacaaaggcataagaacgatataatgttttgggttttacatttaagtcttcaattcatcttgagttaatttttgtataaggtgtaaggaaggaatccagtttcaattttctgcatatagctagccagatctcccagccccattgattaaatagggaatctgtgtatatatccaaaggaatataaattattctgttataaagatacgtgcatgcatatgttcattgcagcactactcacaatagcaaagacatgaaatcaactcaaatgcccatcaatgatagactggattaagaaaacgtaatacatatacatcatagaatactatgcacccataaaaaggaatgagatcgcgccctttgcagggacacggatggagctggaagccattattctcagcagactaatgcaggaacaaaaaccaagcacccatgttctcagttataagtgggagctgaacgataagaacacatggacacagggaggggaacaacacacactggggcctgtttaggtgtgaaggggagagcatgaggaagaacacctaatggatgttgggctgaatacctagatgatgagttgatctatgcagcaaaccaccatggcacacgttaacctgtgtaacaaacctgcacatgcacctggcacttaaaagctgaaggaaaaagacaaaaagaatgatataatggactgaggactggagaagtgtgggaggaaggtgagggataaaagactacacattgggtgcagtttacactgctcaagtgatgtgtgcaccaaaatctcctaaatcaccactaaacaacttatccatgtaaccaaaaccacctgttccctaaaatctatttaaataataataattaaaatcacataattcttatagtaatttaaacatcattttaatagttctatatcacttgtattgatattttgatataaaattagactaatttgtctttcattttttaatgttttcacttcttttttagttacattttttaatttgtaaaacttttctgtggttaaaatatcaagagccgtagtatgaaaaataaatatacatagaaaagacttactttaggggctgggcgcagtagctcatgcctgtaatcccagcactttgggaggccgaggtggtgggtggattatgagatcaggggttcgagaccagcctggccagcatggtgaaaccctgtctctactaaaaatataaaacattagccgggcatggtggcgcatgcctgtagtctcagctacttgggaggctgagacaggagaattgcttgaaccgggcaggcggaggttgcagtgagccgagattgctccactgcacttcagtctgggcaacagagtgagactccgtctcaaaaaaaaaggagagaaaaaaaagaaaacactcactttaattctgtccattgttgaatgatggctgctcaaaattgtagaacaactggtttattgggaaaaaaaattgtctgtatttgcatcttggtcaaggactatattaccttgataaagtcttagtaaagtattgaaagggggagggaaaattggggtatttatgaagctttggaatatgatttaaagaagttcttttatgagagagtttcattacggagaagcaaggattttaatgatttacatttggttgaggtggcaaggtgaacattttgagaagccttagaaagacttggggagtaagctgtcattttatgccttctattgaagagctgaacaatttgctctttattgaaataagattttcagaaagttcctggaatgaaaagttatttgcaactattatcttcttgggcaagtttcctgcgattataaagtcatgttgacacacatgtagtggaatggttaaatcatgaaaatgtggacagtatgctgtgtgggggtggatggttttggttctcatgttccaccatgattctctctgttccttaacagtgtaatttttgctagtttattcattttccatctggtgtttactttttaagaaagcaattgcaggtatagccattgcttttcagacatttattaatgcttaccacacatttacaggaacaactactgtgaaccatgcatggtgctaggttttaaagattaaaatgatttaaggggaaatgagattttcctccaaaataaaaaaacttactctaacttccagatttaattgctaagcacacataattgcacctaaaacaggttgatgagggattgatgagggagagtatagagaagcgcctgtgtggcaactctgttcacatttaattaactgtctatagatggctgctaccagcattgatcaaatgactacctatacatattttactcttacacaggaaaaaattaaattggatcatgatataatatttatataactttttaccacccatgttttaagatataaattctagattaatggagaatacatcaattttaggcaattttactaagaagagcagatattgaagaacaaaaagaaacactctgtaaatacaggtgtctactcgaaggttcatcgaaatttaaatttgttgtgaattcttcacaatgagacttttcattttcattagaattcttgcagcattattattccaggattggaatacagttgcatatgataatctttgtttcctttataataactatgagtgactcagttaggaattcaccttggcacaggactaagttatttctgatctactcaatggagtgtatgtatttaggattattcatccttgtttacttaatgtggttttcttcacacattgttttttagatgtcgtttgagagaaacaaaacctttaactcttactgagagggaagatgaattttctaaccctgggatttggctgctcactgagtgtacacataatagatgggtgcttccattgtattattaggggcattcagtagagggcctctcatctaccagggcacaattgagtattcctgattattgatttgtttatttgtgtttatatatttgtaattcccctttaaatactaatattatcaagtgttctaccacatgtgatttccctgttctgagctgtctaacattaagtataatggccaaaccccattttctgtgggatttgggattcttgacctaaggaccacccagcaccatgcccctgagacctcccatcctgaacacagctaatcggactggagaagtccatctgaggaagaggaagcagttgtcttctgtagtctgaccaggagattagcaagaagtctggcccaaaaactctgccccacaggtttctctaccaaatggtgaaggccaggtgttcagttactttttcctaaggtgttgaaacgtaaagcatgtggaaaacatgcaaatagaaacagcaaaatggaagcaaacagagaccatgaatcagtaaaatccatgaaattaagggaagtgaaaatcaaagtcggaaaatagtggcagccgctccacagtagtggagcatgagggtaggttatcttcaagtagtgaggtttgtgtaaattagatttctttatattttctctactttttaatgctctgcaatttaaaaaaatgttacttttgtcatcaggataatatgttcaaatttttaaaaagtacctaaaattttaaaaaatcactagcttgatttaactagattttcctttgtttatcatcatgactctgcaaaagctgcagcatctgctgctttatgaatgaagtgctgattaggcaagcaaaaatacagttttccagacctcacatttaggcaactgttaaaagcctagtttccgagtcaaagccagatataaatttctaccctgtgtctcaactcagggccagttatggatggtggagagtttgagatactagtggttaagtttaatttcagctgcctgtgtttgtaaccatttgactttatctaaggaaggcaattctacaccttctctcaataattttttttttccacttggttttctctgacataactgagatcattgacattctgactagagcctaagaaatttcatgtatgtgtctgattcagtggttcaaggccttaaagataagcctttaattctgaggaagagcctttagcttctcccgtctcttaatacaaacctgattcatgccaggtttgtctaggggctacgtggatggttaataaaaacatgtaatttctatcccccaaattgtacctatttaggattagatttcagaatcttatttgaaacttaaacaggctttagaaataattttgtcccactctattattatagagatgaataaatgtactttcaaggcaagtagagcgacttgccaagattacaaaaaaatgtctgcgacagagccgagtctagatgtttatcttctagtttccagccagatactagttttatggctagtttccgccatgctctgagggaggcacattttccatcatcttttatctcaacactgaatactgtttttgacacatagtaggaaatcaattaatactatttaaatgaatacaaatacatgatgtaaaatatatcagagaagtctattatgtgttttcagacaagcttttatttctacagtgtatatttttatgaaactgatatgtatttttttagactaatgtgcaccatcaaatagcactcatttttgaaacattttgagcgtgatatgtatgtaccatcaaacggaattgagtaatatctgaagttgtactgggcactctgccaagatttgtccaaagaaagtaatgtgaaattagctttgcctttctgaatatttacaaaatccaagcaaaaaaagaaaaatccaaagggaaaatgctgatctctggaatactttggacaattcatgcatcaaaagccaactgcagagccactatttgcaagtcaagtctcaagatggtatactatctccaggaaaaggcttggaaggtaagtaagcactactgttgaccccaatatctcaatttccacggagaaaccatatttgttaagatgcagagagatctctctaaagtgctattgccgagattaaatttgagccatctgaaggcttcgtcattatcttagatcttagccttacttgtgccttattctgttctttaactatcacttatgctgcaaactgtgatcctattgtgattttacccttactaggtggttttcctggtaagataagtatttgattctgctcaaatttctcctcttgccttcctaactggtctcaatctttctttctgcttagtatcattctgtctcagcacccgtttatctggctgcgctttggccagtttcattgtttatgattatttggttttggtgcctgcctatatgatcagttcaagtcctagccgtgctggaaaatttctggccccattacagaccagacatttccactcacagctgcttctgtatctatcacaagtatgcattcatgcccatgtgcatcaatcctatatcaatagttgtttctacagagatagcctctgaagtccatccttttgtatatggtcataggtaaactgaaaatgggaagtaacaaggtctctgttaattaaaaggtccattaagggctcaatgccaaaagttggatacgggaaagcttgccaagtgcacaaggttagaaacttaattgcacttctctttaccaagatttctatcaactgcagttctcaaatatatgaccttcctttaattttgtactgatgtataaaatgaggattttgcctgtttttgtacttgccatttggaggacatatatgcatgcctgccataagtggaatttacatatgtatatgtaaaactacgattcttggctttatatcagtggaaaaataaatcagattatgtagatagatctgtctttatacctgatttgcttttatatatatatatatatatatatatatatatatatgcacacacacacatacattcatatttattttaatgggcaaaatatttgagaatatttacatgaaattttttatgtagtaatctaattttggaattgcactatttcttttgtagaactccaaaaataatcagtacacaaatttgaaagcaaaacagtaaacttgaagtcatttttggttactctatcttctcagaatactgaggtaattagactacagggtgtccttcaatacttgaaattatattttgctgtttgcaattaagatgcactgcagaatatgttgtcatggaatggccaccccaatggctgtcaagcagacatttttcttagccaagtcacacaggtaagtaacaaggtagattcaaggttgataaaaagcaaaagcaaatccacacttattggtttcctggtgtgacattgagtatactttgggatttcacagaagggttagtcagagtattccttcctatattttgatcagttgctaatacaggtttgattcctctttcaagtagaaatgactcagctataaatttatagctgcctctgtaggtagttaatgcaggtggataagcaatattgacagcatgactaagtctagccaaagcaggtgcatgaaaaattattagtccattctgcaaaaccctaggccatctattctgtaggatttatctgtcttttccattcccggtatcaagttcttaactactaaattaagcttatactgaagaggaggagctaggaaaatcttccttagatattcagatactcaatattccattaatcgattaattaaacaagaaatcaattaaatcacaatttatttgtgcacttttcatgtgacaagcatttcgctggttctgatctcacaagagataaacataagaaaccatttctgcacactgagaactcaaaggtttttgtgggagtcagaccagttatgaggctgcgttccagtttcaaaaatagcagtttatataaagagattgaaatttctgagaagattaatagaattcagacctgagaagaccgctcaagtcaagggacagtgccagaagcgagcatacccctagctgtgttatcgctgcctggtgatatcctgtgggtctttttattttataatatttcagagatgtgttctgtaactcatatatagggagtcaaattctgttatttctattcatgcctggcatataagactgatatgatcttactgttagacttttcatgaagaatggatgttagattcaggtatatatttttgaagttaaatggcccttgttacagatgtaccagagctccccaatatagaagcagttcttccaatattaattactatgtgttgtatattacaagttgccaaggtaccaatagaaaacacacaaagtcactgaatggaaaccccccaaataatgtaaaaaatatcacctcttttagctcttagaaaatgatgtcgacttctttctaaaggatattgttactggagggatgaggaaaaaactcaatttggaggaaattagaaaataatttgcagtttagaagggggttatcttatatacatgttggtaataattcaacattaacaataaatgttataataacaacatagttatcatagtaaactattttataccaaagcagtagtcccagaacttaacacatactaacttttgattcttattacagtgctatgatgtaggtatgtatgtcaccccgctttagatataagaaaaaaagaggcaaaaggagaccaagtttttccaaaatcacagctggtaagtgtcaaagcctagatcaatctagatagcctggttccaggtgccttagtcttagtcttttcaactgtatgctgcctatgaatttatgatacctcacttcttctcctatgctgtgctcatggtagtttatgttaatttttcagttaaaacatttgtcttttccaagtgtgcggtcatgccattggtctatttttataccactacctttgaacttttctccgtctgatgtatttctcttatctacatgtgtagatcattacctccagaataatagttgtagcaatgggcattgttgccctaatgggaattcttcaattgtcttccccaatatgtgtgagttggctttgaggttaagctaaatatatcttacagagctaaggtttatgtaagaaatcaacttcagaaatccagctgaaagtcagtagtgtgaagagaggtagtcagaatgtaaatcatttcaaaggtagagttgagagcatttcttgatagattggatgtgatgtgtgcaagagaaacagaggattcaaggatgactcattttttgattgtcattgtttttggtctggccagctaaaaaggagaatgtattacctactaagatgtggaaggcctgggaggagcaagttttgaagaaaggtcgagaatttatttattgctgtatgtattaatcagggttcttcagataagtagaaccaatagggtagatacgcagtgagagaagtagtgaaaggtggagaaagagagtgaagagtgagagactgagagagagagagactgttttaaaaaatggcttaagggtttgttaggatgaacaaatctaaaatttgcagagcaagccaggtacattggctcacatctgtaattctagcactttgggaagctgaggcaggaggattgcttgagcccaggagctcagggccagtctaggcaacacagcaagacctcatctcatatttatttttttttaattagctgggcatggtggtgtgtgtctgtggtcccagctacttgggagtctgaggaaggaggatcacttgagcccaggaggttgaggctgcagtgagctctgatcacaaacactgcattccagcctgggtgacagagtgagatcctgtctcacacacacagaaaaaataattaattaattaatttaaaaaactaaaaagcataaacaattaaaaaataaagaataaaataaaatttacaaagcaggccaacaggttggaaattctgacaagagttcattttgtagtctgaaggcagtctgggggcaatattcactcctcttcagtgaacctcagtcttttgtattaaggccttctaatgattgtatgaagtctacaaacaatatgaagggtaatttgtttttaccaaagtctactgattgaaatgttaatgacatctaaaaagtacctttacagcaacatctagtgtttgaccaaacaactggatgccataacctagctaagtggacatgtaaattgaccatcacagcatagtaagttttggatgcctactagacatctaagataaaatttcaaatagcctgttaaatacacacatctaaatatcaagagaggaatccaggcaagagacatacattcttggattcatcagaacacagatgtcagtgaagccttggctcctggttccgcagactgtacaagaagcatggtgtcagtatctgcatctggtgaagtctcagaaagttttcagtcatggcagaaggaaaaggggagcaggcatgtcatacagcaagagagacagcaagagagagaggggagggaggtccaagattattttataacctgatttctaatgagctagtagaggggaggactcactctttactctttactgcagggaaggcaccaagccattcatgacccaaacacctcccacaaagccccacctccaacactggggatcacatttcaacatgagacttggaggggacaaaatatccaaccagtatcaaatgctttacccaatttagcacagtgcccaatttattaaagtaagttttcaaacacttctttaaaaataggtgatatctctctattcctgatgacttaaataagatgaatcaattttaccccaaaactgtgtatgctgcttgaatgctacagaaaagaaagaactaaaatatattttaaaaatatctaaaaccattaaaatgtctcctggtgatatttaaaattagaaatagggcactacttatttaagtagtatattaataatgtgggaattggttgaatctttacctcttgtggttctggaactttccccttgcaattgtatatatctgtagatgacttacattatccttaactgagggaaaaaatgtgttatggaagtatttttgattctggttaatgcactttatataaaatgccaaacgtaaattattagaggtaaagatgaggctttgaaatttttatgaaatatttcggtccagaacttggttaacccaaatcctgtcctgctgatcatgcattctccatctggagttcctgagaggctctacatctgagtatcagagtatcactttgataatcactatttaatgtcttacagtatagtacagacctttggacaaaggatgaggtggtacaaatggagtagacacaaggcctgatgagaactttttaatttattttccccttaatgtgtgtcttactactggtataaacaagcatgcttgcaggaaggagaaagagatggctaaaacaaaatcaatttatccattatggattagagtccatgtataacagagagaaagagctattttcactatagatagcttcagatttatggctcaaaaactatgctgctggattgtgtcaaacagtttagtaaaaatgaaatattattctctcatttggcataagacatcatgttgctcgggcacaatgagtgatcctaaaaatataatatggttatagcttctgttaatcaagaatgaggtaaccagcagcttctgaaaacaaagactggtaatgatggagatctcccttgagacataaatctcatctgtgatcaaaagaagagtagccttggctcctttctggggatccctggcagccatgatttttaagacacattaacaaacaactctgtggcagcaggaacttcctgggaagacaacagtagaaggaccagagtagaagatgggggaaaatatcgaatacctaagaacacagaggaaaatatcagatactcagaaaaatatccaatgactaagaaataactcagaagacagcaggatttcactagagtagatggggatagaatctagaaatacgtaattttattgttataagatatatttcgtaatctttctccctgaaattggaagcaatgcaaacacagggctgctgcagcctctattccagaaggcaacctttctaccctgtagtgtagtggccctatttttttttttttacttctctttttccccacctttctcaattgcttttaattcaccaattatatattaaatctctaccatatgttcagtgtcaaactatatgccagtgtaaataattggtattacccttcacacatggtatgtctaggtccagaaatatacaaatatatgagtaatatgaattgtttaatattataaaatcttcctcagctgccatgttcagtggttgtaaatatactgtggaactatgaatggaaaataggtggaaacaaataaatgtatgctcagcaaattaaaaaattctaaccatgttcttactgctaagaactttctacctgcatatattcctggagtgtcaaacctgaaaatgatcttctgcaacatcagtttatttatattaatttgtatctattagacttaggaaaatagtataaaaacaggaaggaattccatgagggactaaatgaaatataaattcgtaatattttttatacctataaaaatgaggccaggtgcagtggctcatgcctgtaactccagcactttgagaagccgaggcaggcggatcacgaagtcaagagattgagaccatcctggctaacatggtgaaaccctgtctctactaaatgtacaaaaattaactggcagtggtggcatgagcctttagtctcagctactcaggaggctgaggcaggagaatcgcttgaacccgggaagcagaggttgcagtgagccgagattgctccactgcactccagcctggcgacagagcaagactccatctcaaaaaaaaaaaaaaaaaaaaaaaaaaaagcaaggatgtcaaatttgggaactattttctatttgaaactttccttctgtctctaaacaagtttaaaagcagcacccccacctctcaaatgcccttaatagacaatgtaatataaataggtactacaactcactaggtttgattcctgtagaagatgaaaagtgactgctccacggcaagccactatgggagattctttaacaaactcaaatggattcgagagggaaaattgttgatgcaaagctgtttaatgagttctgttactgtgaagtgaaatcagtcctcccaaggatcattcactgtgagaggcagaatggaaacttcctaatgtcataaattgttataccgatatttatagcaaaggcaacatagaactctggagtttgaattagtttttttctctccaagaatacatttttagtattagctgtttgtttcaacctgggaagttttagaagttatttctatctgggcattttcttagcttgacagtttaggtaagaagtctgtgtggctatgccagtagcatatctctttgtgacaagaacatgcatcattctttggctgagcaaaagacaaaattatttactcaagataagcaaagattattggaaggctgaaattgcaaatgatgaaagttctacccatagattttgtttgcccatgactttcattctgtccttgcaaataaaagaataacttgatatatttcattgaataatcacattttatatttccaatttactttattaaaatatgattttagtcctttaaataaagttgaattgagaacaaagagaaaaaaataatatccaataatgtcagttcagatattgtgggttaatttaaggatgaaataaaactatataaatttgtccatgtccccatgagtttctcagtgttttgaggttttgctcagattcatttacacatatggaaaactttttaatatctacataagggattcacattcgaagggatttcattttatccctcagtgaaatgaaatcccttcaaatgtgacttccttacaaagtctggccatagtcttgaattatcttagctgcattttctctaaagcgtcactgtccaactgaaatatactgtgaaccacaaatgtgaatatgacatttaaatagtctagtggcaacattgaaaaaataaaacaggaaaataattttaatgtgatataaacatttaatataacatatttaatatatttaatgtaaaagaagtatacttaattttaataaaataatctagttaaccaaatataaatgttaacttttcatcatgtaacgaatatataagaatgacccatgatttattttgtcttctttaaaagaggtttataatctttgcttacagatatttcagtttacactagccacatctgaagtactcaaagccaaatgtggctagaaagactattgaacagagacgctgtatggtacatattcttattagataactattatttaaggaagtagcataagaagatattttaaatgctaatttaaaattctaatgacaaagccatgttttatatgatatgtgtgaataaaacatagtcagatcttttaagtgaatgttttctttgtatatagagagagctgtttctgtctgtggaaaatttctgctgaggaaagaactaacaaatgacaaaaagaacggctttgcctgggacagtagcagaggaaactaagaaaaaggatgtcctaaaatgagttaagaaaatttttacttagaccctggacatcatagattataaaaggagcatttaatgacaaaaatatcataatgtctcaatgtacagtgaatcaatagtaccttgtgggactgttgtctgatactaattgaaacacagtatttgaaagctacagttgtttggtttgagtatgactgtcttcatcagcaagaataccttacatagtgtctgttctatttgctattttttttctattcttaacttttatgggtttatctttggcaaaagctgattttataaggagaaaatctataaattgcattcatggttatgccaaactcctcaggtacaactatcaaataccagcactttccagggaagattgtcttcaggatctgatcattcagcattttaccagaattgttgttggaatctatggagccacagtctctgttggactctatataactttcctccaacctggtcagaaccatagctaatcaagtaataagacattatgacaagaaataccccttacaaagacaaccaaaagagtcagcatccagtattgttaaaaacagttccaagtgtaaccaaatgtttttacttctcaatatttttttaaagtagcattattatatgtaaaatataagctttgtatggcagtagtttttgcattaagccagaacttactatttttcctgaaaatacttactaatgtacagaacttttttattataaaataatgattggattagaatgtatcctaatgactttcaaacatttaattttattattttctaaaatgttattaattttgccacagattattctgccttagtgtactgtcaagataaattatcagcagataggaaaacaaaaaaaaagaagtcaaattttttaaaaaaataaagagaaactattgacatggctcctagaagtctgttgaatccaattattgctttgtagtcactttgttacttcttgtttgcctcagttttatatttcttttgtctaggagggtgtatttttaaaatatatatagataaggataaatataaattaaaattgagaaccttaaaatgcatatgcacactcacttgtacaatgggatgattaaaaatgtgtttaaatgatggaacataggtagctgatacatctaatatttaagacctcacctttacttcattggtaccagtcactaagataaaaggcatattatttattcctaagatcaatttaagtgatttgagattctgactaatagattatgattaatcgtctgtagaaagggattgtgttgagtctgcactaatgggtactctaccttgtctaacatccctgaaaggtaaaacatgagcatcttcatctgaatggaagagagaagtagaatcgttggggaatgagtggagaatgaagatagtgcctctgaaatgcagatagctttctgtggaattaatcagtgaacaagttcataaaaaggaaaaaggcagagatgaatgaggggctctagcagaaactgcaattgggtagaggtgctggcccctaaaagggtttatttaataatctaattgactgttttccagagaggagttatgggtttgccaacttgcatgaggtggcaaggggtagttggatagatggatgctagacaattctagaaacgtatctaggcattaaaaatgattttgaatttgcttacaaatgcttactttcaactaagtactattgtgtactctgctaaagtataatttttacgttgtttttgttgctgctgttttgtgaggggagggaaggatctaatattatagtttctaatgtaattctaaggtacttaccttttcactagcaatgacatttctagtaacctagccttcaaaattgctcattctcagaggtatattcataacagtatttattatagaattatttacaatgagcataaattgaaactaaaaaattaggtaactctttataatagaacactattccacctaaatgaagcacatgtagtatatgttgaaaattaactcaaccatttttcatttcccttttaaaaagatagataagtggttgattcagtaattgatagtgtatttggccatttttgcattgctataaagaaatacctgagactgggaaatttataaataaaatggtttaattggcttatggatctgcagagtgtacaagcatagcacgggcatctgctcagcttctgaggaggcctcagggagcttttactcatggcaggaggtgaaaggggaggagccatgtcacatgggaaaagcaagagcaaggaagaaaggggaaggcgccacatataccaaacaactaaatctcgtgagaactgacttaataccatgagggcagcactgaactaatgagggatctgcctccatgacccaaacacctcttaccaggtgccacctccgacactggagatgacatttcaacatgagattctcaccaggtgccacctccgacgctggagatgacatttcaacatgagattctcaccaggtgccacctccgacgctggagatgacatttcaacatgagattctcaccaggtgccacctccgacgctggagatgacatttcaacatgagattctcaccaggtgccacctccgacgctggagatgacatttcaacatgagattctcaccaggtgccacctccgacgctggagatgacatttcaacatgagattctcaccaggtgccacctccgacgctggagatgacatttcaacatgagactctcaccaggtgccactccgacgctggagatgacatttcaacatgagattctcaccaggtgccacctccgacgctggagatgacatttcaacatgagattctcaccaggtgccacctccgacgctggagatgacatttcaacatgagattctcaccaggtgccacctccgacgctggagatgacatttcaacatgagattctcaccaggtgccacctctgacgctggagatgacatttcaacatgagattctcaccaggtgccacctccgacgctggagatgacatttcaacatgagattttcaccaggtgccacttccaacacgagatgacatttcaacatgagatttgagtggggtcaaacatccaaactacatcattctgcccttggcccccacaaaattcttatgcttctcacattgttaaatacaatcatgccttcccaatagtcccccaaagtcttaactcactcaagagttaattcaaaagtccaaagtttaaaatctcatctgagacaaggcaagtcttttccacctataaacttgtagaataaaaattaacttatttacttacaagatacaatgaggttataggaatttggtaaacattcccattcccaaatggagaaatcagccaaaagaaaggggctgcaggccccatgcaagttcaaaacacagcagggtagtcattaagtcttaaagctccaaaatacactcctttgatgaaatgtcccacatacagggcacacagctgcaaggggtgggctcccagggctttgggcagctctgctcctgtgtcttttccgcactgaagtttcaagctgctgttggcaccacccgtctggagtgtggaagatggtggctcccttcccacagctccactaggcaatgtcccagctgggactctgtgtgggagttccaaccccgcatttccccatagcactaccctggtagagtttctctgtgagggctctgcccctaaagcaggcttttgcctggtaacccagcctctctcatactttctttgaaatctagggtgaggttgccaaaccttcactctcgcagggtgcatgcctacaggcttaacactacgtggaaaccaccaaggcttatggtggcttatgctctctggagtggcccaagctgtactgtgaggcctctgagcagtgactggaaccacagcagccattatgataggaggagcctcctgaggtaacactgggcagtagcactctgggcctattcccataccaccaaaaccattcagtccccctgggcctctgatgggaggggctgcctagaagatctctgaatgccttggaggcctttttctcattgtcttggctattagcacttgactcccttttagttatgcaaatttctttagtaaatgattgctgcacaacctacttgaattcttctcctaaaaatgggctttttgtttctaccccacagccaggctgcacattttccaaatttttatgctctgcttctcttttaaatataacttccaaatttaagtcatttctttgttcctgcatttgaagctggctgttagaagcagccagacaacttcttgaatgctatgctgcttagaaatttcttctgccagataccctaaatcatctctctgaagttcaaacttccacagatccttagggcatgaacagaatccagccaagatgtttgctgagggataacacacatgacatttgctccagtttccaacaagttcctcatttccatctgaaacctcagcagcctggacttcactgtccatatcactatcagaattttggtcacaactatttaagcagtctttaagaagttctaaactttccctcatcttcctgtcttcttctgaaccctccacactgttccagcctcagcccattaaccaattccaaagctgtttccacattttcagctatttttataacaatgccctatgccttggtaccaattttctgtattgggctgttcttgctttgctattagaaataccttagaccgagtaatttataaagaaaataggtttacttggctcttggttctacaggttgtacaagcatagtgcttgcgtttgcttggcttctggggaggcctcaggcagcttttactcatggcagaaggtgaagcaggagcttgcacacacatggtgagatgaggggttcaggggtaagagaggtaggggaggtgccacacacttttaaacaaccagatcttgcaacgacagcaccaagccatgaggaaaccattcagatgaccaaagcccctcctaccaggccccgcctccaacgttggtgatgttagaaatgctcgtttcccagtgccgtaaagaaatagcacttgaacataaatttaacttcctcagcaaggccatttttagactttctgcagaaaggatacactcgccagcagttttgccatgagagtatattgaacaaaggagactgggttatttataacctgatccatccactctacttctgtgtccagtttttattggctgaatcggaccttatatttagatggagaggaaagtctctttgaagaggaacctctactttactttttacagtgattacatttctagatgagatttgggcagcaacaaatattcagattatatcaggtagcgacataagaaaagtaaagggaaaagcaaaaaggagtgaagaaatgtacagaagggagaaaaaaagaaacaccgaaaaaagaaatagaaatgataaactttaaccgtaattattttagtgaataaaattttaataaataaaggagggcattttgtagttttttgctttatacatttaaggaatttttttttcctaagcttttcttactagttttaaaatatattaaaaaaaattaaaaattgtatacgtgcatctgcttttcttatttggaggctactgtaatgtttaaactgcattttatttattaatatactccttgtgtgagaaaggaggctcacaaggctatgtaaaattcaacaagctagcataaataaaatgtttggaaaaaataaatgacaaggcaatatgtgatcttaaaacagagtggtaatgaggtttaaaaatatataacattatgtccaaaaatgagattccattatgtctggcatgtaagaagagctcaaaagaagacagatttattttatgtgcttaataataaaagctaattgatgtattctagacacaatacccacagtgtcctcaggactttaaaaatctcatgcatattttacaattaaaataaacattaactaagtgaatggcttatatgtcccttccccagcatgtaatcttgtctagaaccttcgtttggttcactttgtcagtaaaacacagggaaacataaacttctcagaagaggcaacaattaagttggaaatgttgacaaggtaaggtagatatgggacaaatacttattagcagtcatacagaatcttgaatgacacttggggttttcacactctgttgaaaaagtaacgcctatagtagaatgttcacttcttgttttcatcatctaaaaatgtatatgagcaacctggagcgtgtttagaggagtgtgactggaagtggaaagacactttttatgacaagcgctaaaagaaagcagttcgttttggaggccttggaaaaagagcagggacacaggttctgcgtggtattcttttgcaaatacctgaaaccactagttgggaaataaattaaatgaattaataaactaggaactgtagtttgaagttagatggagtggatttggaaccgatttaagattttttaatgagcagatgattgatgaaattaattgtcacacaaattgatgtttgctattaatatttagctttaactgaatgaatacaaggtcagtgctcaaatattggaaatgttcctggactagacaattctaagattgctacaatgctgccagatccaccgttggactttccttaattcttattcaataattaatgaatatgaaattaatcttcataatgtaacattatgaagcacagaaacataaaaacaagtttatctgtgaatgtatcatagagaaaaatgagatttaacatttaaaacagtggataatagtaacattgaggctcctttacatctcgatagatttttaatgtctttgtccgtcaaagtattcaagtatttgtggaattcagctatgtaccagaaataaagtagatcaggtaatacaaacaaacaatttaatatatttcaggagaaaaattagaaaatattcctccttttacaacacgtataaagaaacagctaaattgataatctcaggtttttgctttgtattgaattttctacccgaaaagccttgggcagtactttttcaagaatgatgttcttttcatatttgactttaataaagacagcacattgcccgcgtccataaaatggtagatgagcaaattgctctgtgttttactgctcactcgactcctacattcatagtatttgacaagtaggacttaaatgggaacacttctttttttcttggagagggcagttactctgaaatcttaaatgaatcatattggagtaaggtgacataaatttccctcctcatttattaagatccaatctgcatgcagtactctgccagacacattatattaggttggttaaacagatatgatactagcttcttaagagaataaaaatcagatgatatcaacatagagacccagggttattattcatgacagtgccctgtgattcttcatgaactaatatagctcgcgaaagcgaagggatccaggaattctgtgataaatatgaggcagtttgtcctgaccagagatctaaagattgaaaacagtcatgagaggctttttgagagtctggaggacaagtccatgactgtaaggaggtcatggagaaacaagcaagtactgttacctgagcatcggtttgagtaacaaggagtagacgacgaagtgaaaggaccgagggataaaatgttggtgcccatggggtaagataaccatatcatgcagtcaggaatcccaacagaaactcttgcatattactaggtcaggatgcagatgagggaaaaaataaacatggactgcaagcatgaattctgatactgcagtggtgtagagatagcactacctacagcattctgcctaaagccaatgatctctgagtgggaattgacaaaaaagcaccactctttagagctttaggaatgagaatctaaaagaatttctcacatctccgctagccctcttggactctccattgtgctaatcatattcagtgctggtctctaacacttcaggggtctaaccgaatcacttttcttgtgtttgtgacccagcttgccccgaatgcacaccctttggatatcatccctccattcttggcccaatattgtcccttcactccttgtagatctgaatttaaaagtagaacaagcaggcacttgcatctgcctaaatagtcatgtgaactacattttgaacactagtgttctgaatcttcatttctgcaagatatctttaaagtgggatttggaattttgttagaattacatcagaattattgataataaggcaaataagctgctttccaagggaaacgggaaatctgtatactgtatagtgataaaaatgatgccattaaacatcgtaagttaagctctataaattacccatactccagatagaaaagcaaaccaaacagaattaacccagaaaagggatttcaaattatatagttaacatttgttttccttttttctaccctgggacttattgttatctattagtcaccttccttagaaaacatcaagtctgtggataaatacacttaatagtgttagcaggaatgctattcatgacagacctcaacatgttgactcgtactttatttaagctattatgagcttggcgaaaatctgaaagaaagacgatgcaatttattttaggaaatacttcttaaaagtaaagatttcaaatgtgggagatattcatgaatagaaagagttggttttgctctcattggttctgcttgttttgctactgtctagctatatgagggactttaggaaagccattcctaataaggtgggttttagttttctcatctgtgacattaaggaattagaaatgatcatgtaaagggaccatttccttctgttatactatagattgttattgatacacaaaatgattggttaattcaagttcaattttgttaacctgaaatattttgaattacttttgagagatccttgtttaaaagccataggcaattttgtgtgtgtgtgtgtgtgtgtgtgtgtgtgtgtgtgtgtgtcttttagctcagtggttatcaatggggcaatgttccctttcagcaggcatgaaacaatgagatattattgattgtcacagatatgggagagctactgcattgagtgggtagagactacaaatgctgctgaacgtcttctatgcacaggaaagccgtcccttaacaaataattatttggtccaaaatgtcagtagtgccaagattgagaaatcgtgcaactagttatggtccagattgatggcatacctcatccttcatgatatagtgatccaagtgccttgtcatctaaaccaaacagagcagaatctccaactctccctgccctgagaaaagggactctattttctgtcagacagtaaggattggagaccgtatttgctctcgtgcttgagagcccacatcattattgggttaacagtcatagctagagaattcagtctgtgtattttttttattagtgttattttccctttctcgtaatgtaacaatttttataaatgtttcatgggctatgaaagaagggcatttttcattttcatgccactgctttagcaatgtatagatacaatcaatattatggattgtgatttaggtgggtgttctatatatttacagtcaattaaaaaccattgaagagcttttcattgatttcattaatttctattatcttaataattctatattcaggcagggctactttagctatttgtgtgtatgtgtgtttccgtgtgtgtaaatgtataaatacatgtacatgtgtgtgtgtgcatatacatataaaatcaaaggcatacctagacctaaacaaaatattctgttctcatgatgtaattaatctcataagcaagataccattctctgtgtgacacagtttttttttctagttagaattcacattcactaaatgtttaacactctcttgatttcactttaaaaatagaacatcaggctcacatatggctgctctctacactagaactaccctcaggggtgcacaaattgaatacactcagtatttttctcctggagttttttaaaaactccatttatttccttaaacttttgagacaacagggctgatgttttctgtaatgaagttagctaaatgagctttttattgaaatttattcaataagattcattcttcatgtgtcaatcagatatcacgattaccatgctcaaatccaaattcaaatttttgttttatgagatttcctacacttctggagacttgaattctggtcttctctaacagtcattatctatttatctttaaataaataacttctgtacactgtggattgctttatttatactttggtaatagttttctgctcaatttgacccagagataggctcaggtagtaatattaagggcttctgaaaaatatcaattactatacatatatgagtaatggtggtagtataatttacacattagacagcaaagcaaatcaacaaaaactaaattaaatagggcaaaaagatgctgtggtacgaaattttctggataattttagttttagatcatgttgttaatttataattgagaatttgataaattagttcaatcttcattaccaaccatttgaaacactggctgatatcatggccaggtaaattgtgtcctttttttattaaacgtagttgactgaacacttgcttttcacacattgaattgggtcctggcaatacttggatgaatcaaattgtttccatatccttgagaaactgccagtgcaggcaaaatagggtaacagatgtaataataaatgcatgcacagcatagattggagcaaatggaagcactgacaaactcttcttttttaaaaaaaataattttcatttttttgctgatccataatgtggtacatattttggaggtacgtgtgatagtttgatgcatgtatataagatttaatgctccaattagagtaattgggatatttatcacctcaagcttgtatcttttcttggtgttgggaacgtttcagttcttctcttcttgcttctttgaaatatatttttaaaatgttaattatcatccacctactatactgtcaatcactagaacttattccttctgtccgcatttttgtaaccattaaccaacttctcttcatccctccctccccaatacccttcccagcctctgataaccaccattctaccctctatctccatgaaatccacttttttagcttccacatgagtgataaaatgcaatatttgtccttatgagattagttaatttcacttaacataatggcttctagttccatccatgtttctgcaaatgacaagattttattctttttatggctgactaatatttctatacacatgcacacatatatatatatatatatatatgtatcacatttctgtattcattcatctgttattccatatattggctattgtgtatagtgctgtaataaacctaagagtgcagatatctcttcaacatgctgatttcctttcttaggctgtgtacccagcagcgagattgaataatatggtagttttatttttagttttctggggaaggaacactatattgcttgtttttcatagtggctgtactaatttacattcccaccaacagtgtgcaacagtgtgcgagagttaccctttctccacatcctcgttaccattcataatttttgtctatttgataacagctcttttaactgtgatgagatggtgtctcattgtggtttgattctaatttccctgatgattagtgatgttcaacattttttcatatgcctgttgaccatctttatgtcttcttttgagaaatgtctgttcgggtcctttgccaatttttaattggattattattgattttttttgctattgagttgtttgagttccttatatattctgattattaatgccttattgtttggataatttgcaaatattatcaaattctgttggctggctctttactttgttgatttgtttcctttgctctgcagaagctttttggcttgatttaatcccatttgtctatgttgctttgcttttgttgcctatcttacacaaaaaatctttgcccagattaatgtcctgaagaatttccccagtgttttcttctagtagtttcatatgttcatgtcttacatttaagtctacaatccacgttaagttgattttgtatatggtgagagataggggtcaagtttcattcttctgcatatgtatatctcattttcccagcaccatttattaaggagcctgtcctttttccaatgcatgttcttggcacctgtctagtggacaaacttttaatttttctgtgagtaaaagcatttggacagatgttattgggagtggtaatatcattctttgttttacaaaacaactctgttaatagtggaaatgttaggtcaaaagggtgaaaaatgtttttcagagatatcaataaaagtctattgcaatgcaaaataatgtattgggtatggaatagttacaaaaatctttgtgatcttgattaagaagtgatcattctacaaatagtgacatgttgaacatataccatgttcttacctctgtgtttgtcatctcatataaactaagtgcaatagataaaatttggtttaatttgtctctacaaatttaattgtaagagtttaggatttgggatatcattaactcttttaaatctagagacaagcacattgcaaaaagattttttttttaattatcaggtattaaagacaactgagaagtgttatactgaaatacttaaatgacataatttaaagattaaaatattgaggtaagtgttagggtataggtctcacttagaaagtacctgatttttgttcattggattcttaagcacactcattagaactcaaatattagacataatcaatcaaccacttttaaacattatttattgaggcccatttagaatcttggcaaggtatgatgctggatgttacagagaatagggtgggtattgaaaaacaacaataatgaaaaataggacaggaacaaacacttgggagtttaaaaaatatggaaagctattggtctaatttgaaattttctttttctggttctttaagatcattcagtttatgtgtacaactgtattttgaggtagaaattgggatatatatatgaggcattttaaactgaaccatctttaattaataatttattctaccccaataataattaatattctagcctaccaatagtaaattcaaaattgtggtctaacagtatgtaagatactgcaatttcacaaagtataagatacaatatttctcaaaaagaagcatatagtctcatatcggtaagtaatcacctgactatgtgacgttaaatcagtgtcatttattgataattacacaccaaaggaatgcagcattttagagtcgtaagagacttccaaaatcctctaatctggcctcttacatgatttcatggaaaagatgtttgaattaattcaaaataatggataatagggtgaagacattccctaataccagcaaggagatttctactgaattaactctcttctagtggatagctcaaggggcaaccttttttatacatacaaatcaccctttgattgtaacctcttacgtaagttttcagcattagagaagaaatatatttgcctatttctaactttatagagaggattgaaattgacccagtgctccatctcatctcatgccattcaaatcactacacagattccgaaaaggagtctatgaggatgaagtggagtgaaaatgattaaaagaggaacttgctagaagtggtttaagttaagtgtgttactcaatgatcttcaggttgataagctcaactttagtattatctaagttatttatgacagtttcacagataaacgtatatgtggtgctttgaaaattgaaaaacgatgctggataggaaaacaggtggcaactgaaatattcataatccaatgtccctttaccttaatcatggactaaacaacagtttacagtacagtgtgtgattatattaagaatatgactaaacatttatgttcatctagtagaaaataggtgtgaattttgaaagtgataaatgactaccttggtggtattgtaagagctgtcaccaaaaatgagcaaaaatgatacaacgttttgttgtgtctaaatttttattcaaacaatataatttcttttgtaacatatgtctcattttattaaattcattttatgtgccacatattgccaaacagctcacattcaagtacttcaggagaaaaagttgtatctgctttgtatattgaaaataatcataagtttcttcatatgactagggattcaagctgaaaaaaatgagagatgggcctgttaacgtggatgaaatctcaaattaaacaaaaaccatgattaaaaaatggtgagagtaagcacgtgaaaagatgttaaacatcactaaccattaggaaaatgcaaatcaaaaccacaatgagacaccacttcacattcattagaatggctgtcatgaaaaaaatattgcaacaacaacaaaaataacaagtgttaacaaggatgtggagaaattaattggaatctttgtgcattgctgctgcggaagaaatggtgcttcctcaaaaaagtttgcatagaataactacatgataaagaaatgccactgctatgtatgctaggtatatactcaaaagaatggaaaacaaagacttgtacatatacttgcgtgccaattattataccaacattactctcagtagccccccactccccgaaaagtagaaacaactcagatgtttattgatggatgaatagaaaaacaaaatgtggtatatacatgcaataaaatattatttagccttaaagaggaaggaaattctgacacatgctatcccatagatgaatcctaaaatcattatgctaagtgaaataaagcagacacaaatggacaaacagtatgattccactaacactatgtacctaacacagtcaattcatggaagcacaatgtagaatagtggctaagatggtcatggaagcacaatgtggaatagtggctaagatggtcatggaagcacaatgtggaatagtggctaagatggtcatggaagcacagtgtggaatagtggctaagatggtcatggaagcacagtgtggaatagtggctatgatggtcatggaagcacagtgtggaatagtggctaagatggtcatggaagcacagtgtggaatagtggctaagatggtcatggaagcacagtgtggaatagtggctaagatggtcatggaagcacagtgtggaatagtggctaagatggtcatggaagcacagtgtggaatagtggctaagatggtcatggaagcacagtgtggaatagcggctaagatggtcatggaagcacagtgtggaatagtggctaagatggtcatggaagcacagtgtggaatagtggctaagatggtcatgggagcacagtgtggaatagtggctaagatggtcatgggagcacagtgtggaatagtggctaagatggtcatgggagcacagtgtggaatagtggctaagatggtcatgggagcacagtgtggaatagtggctaagatggtctggggagacggaataatgtgaagttattatttaatgagtacgaaatttcagtctggaatgatgaaacgtgtcaggacataacagtgatgatgtttgcactgcagtgtgaaaacccttaacaccactgaactgtacacttaaaaatggttaaaatgatcattttatgttacatatattttatcacaacaaaaatagaatattttaatcttgacaaacgtaaccacagaaaacaacttacaaaatagaatttcagaaatttttgctaaattggaatacatgctgttttatttctacgagaagatggatagtaggttatttggagctgaagaattataatgcagcttccccaaattgtgatctcctatgtggcagtggttagaaacaaataaaattcttatctcttatccttaaagaaaatcgaaattaccacacatgtatttattcagatagctgttctgagttagacggcaaaatagagcttttattaaaaagtaggatatattaaatttaaacatatataatgtgtagatcaaacattcaaaaagcagaactaattaaaaactggataaacattttagaccatattaaaaattttaggccgcctttctaaagtctagattacattggattaccattgtagaattgaagagtggttggttttgaattttacagttgtaattgcaaacttgcaaaaatatatattttaggtgctactatttcttaattttcattttgtaaattaactagctcttttgaacagcatttttttttcttagtatgatgcctatgagaaaaactacctgccttggaggaatttgtaatagagaaagataatatgtgtgtgtgcgtgtgtgtgtgtgtgagtgcatatgtaaatatttccatatattatatgaaaagtgaagttgaataacaagagaagtttttctttgctaaggaaaaaatacatttgtttttcattaagtaaagattattatactggcattattttgttcttacattggttttcagaaagttcaatggcatattccgctgtatgagccatgcagagctgcatttatctactgtattatcttcctcccttttttctagatattccttttttgtctgtgtttttcttcctgctggtttagtgttatgcatatcttattattttactatgcaatttcttatcttgttgtacccaagcgagttagtgagaacgccacactatgagatgaatcaagagtcctttattaagccggcggccaaagagacggctaacgctcaaaattctctcggccccgaggaaggggcttgattaacttttatacctaggtttaggaaggggagggggactcaaatgcaataattctacagaagtaaaaacatgcaagaatcaaaagaagcaaaatggttacagagagataaacaatttaaaagacaaatggttacaaaaagagcaacggtaccaggtgcaaggctctaaatctttcattataattagatacagggagtatgccggacaggaactcaaggctttatgttttctctctttaagaaaaatcctgggaacttcatacattgttggtgctagtaccttatcagttcattgggctcctttgaaatgctgaggatctgcttacacaggtcaactcctggcagaagcgggttgggtaaggagcccttagtgtcttgtaaattatggggtcaattggagtttttccggctttcccagctagagagagtcttatttacatgagaagcaaggctaggtgattaaagagacaagcaggataaaattcaaagtagcgagttagagtaaaaacaaggttaggcatttcaatcttaacgtcagaagattttgaggttaaataataaaaccaaatctaataaaagtaaattataaaattggtcacaggaaaaaaagggggaaatagataaatataatgtaaagagccaaaggtgagttgaatatagtgctgtactgaatcccgagttgggattaacctagacttgcagctggagttcttcagcaagctgtgatgtctctgacctagatttagctatttgatatgagatcttgtaataggtgaattttgttatgtgaagttgtgggggatgaagttggaaaggactttttatgtgacctagaatcatctgtttgtcatttgaagtcagatgaactattctctcttctgggaatctttcctacttctgcctattcatatttagggtaaatgattattgtgtttatctgagatgccctatggttatgtttgaatattacttacctgtctcaacaatgtttaatacggtagccactagtctatgttagactattgagcacttgaaatgtaattatttggggctctgagtttctcaaatcacatggttggaataaatttagactgcatacatgtggagggacagacctagttatttgattcatctttcccatgatgaatttaaacttttaaatttttttgtcagacctatgtcaagacaagtttcttttttctttctttctttttttttttttttttttgacagagtctcgctgtttccccaggctggagtgcagtggcacgatctcagctcacttcaacctccacttcctgggttcaagtgattctcctgcctcagcctcctgagtagctgggcctacgggcgcaccaccatgcccagctaatttttgtatttttagtagagacgggatttcaccatgttaaccaggatggtgtcgatctcttgacttcatgatctgcccgcctcggcctcccaaagttctgggattacagacatgagccactgcatccagctgacaagttttttttttaaatttgttgcattggttaagtttttttgtcttcactgtgcttgtactctgttaaggtcctagatttaatgcacaagcctcagttttaaccaattagttttggtaggcccaaagctcactggctctgtaagaggatcagaatctaattccttgatcagatatccaggtccagtgctcctctgctcctaccccttgtcaccacggctcttgcaatatattatctgtgtgtgtgtgtttgtgtgtgtgtgtgtgtgtgtgtgcgtgtgtcgtttcattagaaatctctaggtgttattttaggattgtttctgagttagcgtaattcctgatttgggggatcaagaagattttattaacagtattcagtgtccagtggaatgttgcttaggatttgtaagagaggaagaagatcaaaatagtgctttctgaagatttttctggttgtttgcctgtgagcatattacaaaggaaagacagtcgaacaagatgccatttatttaatggctttgatgatgaatgagaggaaacttgttttaaactgaacacaaatctaaagacaaatttactaaatataatttgtccttttcagatctatgtacagttactctcccttacaacgatattaaaaactctcacagacattttttttctcccaagaggattacattattgagaaatgtaaggggccttaacacttgccggaataattaatattttgtccgtcatctatctaagatgagttgtctcgaacagttctgtatctcatgtggctttagtttgatcttagaatactggcttagaaacctagggatagcatggtctggataaaaaggaaggtctgtaacaatgattgaggctattggtctatattgcaaaacattttgcacatttgtactttttaaagtttctcttttttattttacattgatgctaataaaaaggcttttaaaaaatttaccattatgttctaataaaagtccttgctttgatttggaaaggctaagttatgagacagccacataattttcattaatatcaatcatgtgtacaaatattttagcatgaattcttaaaagcttaccacgatttgagcacagttttgttgactgatgctttcaactttcaaggcagaagatattcaaaagtagcaaataccctctccagacttttttctctgaatgtgaaaagcctataattagcaagtattttgtcacttggtaagggaaatgcttcagagataaacaactcatggactgtgaaacactgtagcagaattccaaacatttagatttggaagttttttattcattcgatatttgagtgcctgttaacgtgaatatgcagtgctgaattggacagattttactctaatggaattaagaatctggaagagaagacagacattacatttatgattatagataggatatactgtaggtaaggagaagtgttgaattttctgaatgtttatatcaaagtaatttaggtcaagattatgattcacaaaatgtggttctcagacaagtagcattaacatcatcaggaagcttcttagaagtgcaaattctaggctccacccaagacatactgagtcagaaatactggggatggaactcagcaatctgtgatttaatgttttctaggtggtgctcattgctcaagattgagaatagctgttctaggtcagagtttctcaacttgagcactattgatatttgggccagaaaattctttgttacaggagtctgtttcgtgcattgcagtttgtttagcagcattcctggcctctaaccattagatgccagtagcatcccccagtagtgacagccaaagatgacaccagaaattgccaaatatctccagaaggcaaattcttattagcagttccctgcttcccctcccccacattgccccaggcaatactcaaatgacttgccctgccttttatcttatcctatagtgtgtggtaaggtgctctgaaacaggacaaaggaattccaccatgtttattcattatgaaagaagtaaatttgagcccaagaccagagatggtccaagttctggtcattttagtctttcattttttgccttgttttcaacctatttttcttctcacttcaataaatactcttatatattaatcctgttttatccttaaatagtaacacattctgtttatgttctaaacttagtgatttgatgaatctcatgtaattaacatgacggttagactcaggcacctgcactttccaaagatctttgaacataattaagaaagtgaagggcataattttaatagtaaatcaaaatattctcattgatgaattatgttataataagtctctgtcaatcacagattctcttgggaatttgtttctttccaagaagtgctgagtctttctctgtagttactcatctattatatttcaaaagtgtttctgaatccatggttatgaagtaggaatatccagtttcttatctgtctgttaaccaagttccaaagtgttttagttttctgggttttagactataggtggtcctgtttgagattgctaagacccaagtagataagagtagttgcatttaaaaagcagagattactgcaagtatagaagtaatgcattttggtaggtttgcaaacatatgtacactttctaaaatgtctagatagctgtgtacctatggaattttttcacaggttagttttgctggtaggcctataacaagattcaattatcattaatatttggctcacattagctaactcataagggtcagtgatatggtttggctctatgtccccacccaaatttcatctcaaagtgtaatccccgtgtgtcaagggaggcacctagtgggaggtgattggatcatgagggaaattcccccatgctgttcttatgatagtgagttcttatgagatctgatggttttataagtgtggttaccctgctctctctctctttcctgtcaccttttgaagaaggtacttgcttctcctttgccttctgccataattgtaagtttcctgaggcctcctcagccatgcagaactgtgagtcaattaaatctctttcctttatgaattacacagtcttgggtatgtctttataggagtgtgaaaacagactaatataagaaatttgtaccagaagtggggtactgctataaagataacatgaaaatgtggaagcaactttggaactgggtgacaggcagaggttggaacagttgggagggctcagaagaagacaggaagatatggaaaaatttggaactttctagagacttgttgaacagttttgaccaaaatggtgatagtgatgtggacaatgaagtccaggctgaggtgatcttagatgaacagtttcctcagagatgaggaacctattgagaactggggcagaggtcactcttgctatgctttagcaaagatactggtggagttttgtccctgccctagagatctgtagaactttgaacttgaaagagatgattttgggtatctggtggaagaaatttctaagcggcaaagcattcaagaggtgacagagcataaaagtttagaaaatttgcagcctgaccatgtggtagaaaagaaaaacccattttatggggagaaattcaagctagctgcagaaatttgcataagtaatgaggagctgaatgttaatagcgaagacaatgaggaaaatgtcttcagagcctgtcagacctccatggaagctcctttcatcacaggcctggaggtctaggagggaaaaatggttttgtaagatgggcccaggaccccactgctctgtgcaccactgggacttggtgtcctgcggcccagctgcgggtctaggaggtctaggagggaaaaatggttttgtaagatgggcccaggatctcactgctctgtgcaccactgggacttggtgtcctgtagcccagctgctccagctccagccatggatgataagggccaaggtacaactcaggctgttgcttcagagggtgcaagcgccaagccttggtggcttccatgtgaagttgaggctgccagtgtgcagaagacaagaattgaggtttggcaacatttgcctagattttagagcatgtatgaaaatacctggatgtctaggtagaagtttgctgcaggggcagaaccctcatggaaaacctctgctagggaaatgtggaagggaaatgtggatttggagcccacacacagagtccccactggggcacttcccagtagagctgtgagaagagggccactgtcctccagaccccagaatggcagatccatgtgtaagaattaaagaaagaagaaagaaacatgaaaagcagctcaacagtcaaagacacttttattttttaatataaacctgagagggacttctgaccgatttcagtcaggagcactctctcttacagactaagagtatttaaggattcagggtgggaaagcttatcacaggctcggaatgtttctgtgtctctttgtcttgcttctctgggagagagactttttgtgtctatttccatatatcttcctgaagctgcaggcatacccgtctgagttgcttttacctttcctatcttagtgcacctaaagggaaagggatgtgcttattaggtccactattttactggggcccattgtattagtgtgaagtttggcgattaccaacacaccttcccccttccttctgtgcctgagctgccttatctgtgttttactgtctgctcattctggctgcttgttgttaaaagagaagtgatttccttgaaatgcacgaggttagaaagggagctggaacttaaaacagtggtatttgaccaggatgacagtgctcttgctctatcaccatgaacagcttgtaatgtgcacctggaaaagctacaggcactcaacaccaacccatgagaacagacgcgggggtggaacactgcaaagccacagtggtggatctgcccaaggccatgtgaatacaccatttgcattagtgtgtcctggatgtgagacatggaatcaaaggagctttaagatttaatgactgcccccactggattttggactaggatgggggcctgtagcccctttactttggccaatttctcccatttgaaatggggacatttaccaaatgcctgtacccccattgtatcttggaagtaactaactggtttttgattttacatgctcataggcggaagggacttgctctgtctcagatgagactttggatttcagacttttgggttactgctggaatgagttaagactttcagggactgttgggaaggcatgattaaaatatgaaaagggcatgagatttgggaggggctaggggtggaatgatatggtttgtccctgtgttcctacccaaatctcatctcaaatataatccccatgtgtcaagggagggacctggtggtaggtgattggatcatgggtacggttcctcccatgctgctcttgtgatagtgagagagttctcataggatctgatggttttataagttgtggtgtcccctgctctcttggtctttcctgctgccttttgaaccaaagggacttgcttctcctcatcttctgccatgattgtaagtttcttgagatctcctcagccatgcagaactctgcgtcaattaaacctctttcctttgtaaattacccagtctcaggcatttctttatggcagtgtgaaaatgggctattatagtcagtgagggtcaagcatgttttatctcaaccaacaacagattcttgggtaggatggcagtaatgcagtttgataccaaaaggtgatggataggatgatgatgataataaataatatgtaataagaacaaattttagaaggatatgtttcaaagagtacagaagtttgttagacctgactggtattggatagacataacattgtttaagttcgacagaaggagaagatccaccctgtgtggggaacaatgagaacaggtctgaggtacagtgaatgagattgttgatttatgggaacggtgaagttttggaaaatacacagaatgagatgtggcatacttgaaagattctattccagggaaaacatacacacactggaaaatggagatctcccttagagactcgggatagagaaagaagcagctaaaaagaattgggttctatcagaataaaataccaccagtcaataagaagataatcaattaaaaacaggctaatgacaaacactaccataagatgataacaaaagtctacctgcattaaataaactgcacaattgtactttaatgtagcgggaggtagaacatgtacccttgaactaaagctaaagccaagtgagccccctcctcccttgagtatcatctgctagtatgggagaaaaataattcaagacataatcctgatcataaggaaaatagaatccaatgtttgtaaaacttgctatataaagaaaagtattgcttactattgctggacaagaaaaattcaagatatgaaattctgatcattaaaaaggatcccaaaatttattaaaatattatgtgtaatgaaaagataataaatatttattgaatgaattcctcaattttcctatgaattgagaagtgctcatgaaaatgcataggtaaattataaaatgctattccatttcattcagggctctgctgagctgaaataccacagagatccctttccagactgaattgtttgaaaaagttctccctatcactttcttcatagcacatatcatttgaggttttactatttttctgtccttcactagagaataagcaccatgtggtcagtgagttcatttgttttaacttgtggtctctcatacctagaatagttctggccaaatagaagacactcaataaatatttgttgaatgaataaatgaataaaaaaacttcattaaatattttgaagggattttcatataaaagaaaaagaaatgctgaacttttcagcaaagtaacccatgtatttgagataaaattaactcctccactttaagtttgatttacgcaaaaaaattgtacatttttaaactataattgtaacctgataaatatattttctaaataagttaataaattttggaaaacatttgatgcaagatatactgtgagagagccatgagatctggccagttgaccatgttactattggaaatgttaataaaacagtaagattgctgatgttgctttccattagaaaaaaatatcagagaaacatatgctaaggggataaacaaaaatgaggagtctagagtctacttgatcttagttattgagacaattctattaacaagagagtggggggccaatataatgtggtctattaacaagagagttaaggatcaatataatgtggtccttaactatatccttacataatttgacacatgaatgtgcaacatagtaaagcattagtgactttatcatgatgagcatcagatttaggatcctgtaatgaacacatcccagtctctcttctagctaaatattgaagtcagaatggagagattgcatcctttggaggcttgacggagactttgattgccatttggccttaagctccatatcaagctaacatgaattagaaaattattcccacactgctgtaaaggtgaagccatagactccatgtcagatcctcggcacatatgtaattgagtttgtgccataaatagcaaggtagtacagaagttacgtgaaaattagtctgtactatagttacaaatatgtatagtaaaaattgtgattaaattcagggcattttaaacttgagttgtccttttattattcggagacaaatatagtaaaatctagaggagtggttttaccccaaaagcccaagaattattcatcagcagaacaaaggcataaattgaggcctcttgaatcccaatccttttgtactctttaatacaggtactcttggatttatggtgagtttatgtcccaattagcccatcataagttgagaatatcataagtcaaaaatgcgttaaatactcccaacctaccaaacattatagcttagtctagcctgtcttcagtgtgctcagagtacttacattagactgtagttgggcaaaatcacctaacacaaagcctattttataataaggtgttgaatatctcatgactgcatgtcactgcctggaaaaagataaaaattcaaaattcacagtacattgaaattgtgatggttttatatcatcgcacagtggaaaaattactaacttgaaccagcataagttgaagaccatctgtatatgacacttacctgcagagaatcatctggattctaactgaataaagccctcaactgagatttttttattgcgaaactttgatttgaaacacagtgaataaacatcaaaatataaggtacaaagatacaagtcaatactttgaatataagaaaagcaacctttgacaataagattccaagaccaggatagtcaacattactctttcatcgtgactttaggatgaccaaggcaggcacaatgaagataaaatatggcatatccttgttcttcttcagagccatgagtatttgctttttgtttaaaggtgtttttagcagcttgaagaagctgctaaaccattttttgactctgaatgttcaggaaactatgttgagctctgaagatgcaataatttttaagttatctacatatatctctctctttcttaccaaccatacatctgtgcaccatgttagattttatttgttatgattctcaaaataggagataatgaaaatattaacagactgctgtttagtttataaaatgctgtttttcagttaatattaaattctgaacaatatgactagtattcttatggttgtcttactcatgaggaatctgaggctcatagattgtaatttgacacaaattacaaaccttctaaatggaaaagcacaagatagggatttctgactccaaagccagtgtttgtttgtttgttttcttactgtgttgcttgtagcatctacttacaggcattattattattgcttaaaaaatcttgccatctgtttacattgacttaccactttagaaaccatttgctaaaaagttgacagtataataaaagtattccattattaaggatgaataattagaactagatgtgaaaggtgaaagggtagagtttaaatacatataatttattatttaagaaacttctaataaagaagattcttttacaatatgactgactataccttccaaaatttcagtgaatgttattaaatcagcatcctcaaagatttcatgtctgccaagtgttgcagacaaaaataaaactctttgaaagcatcttgccaattgtctctagctcctttatgtgatgaaatgtttgtagatttattataaaatcataatttccattttagtattttcataatactatatttgatagaagtcacttaattaaaagtgttgtcaagggaagtcagctgaaaattaagaaagcacagacagctgcctctgttgctaccatgaaatttatgtcttttaagaagtactttattctcattcaacaatgtttgcatgttggttaatttcaaatgtatctttcaaatttatgaatgtataatttttattaaacaaaaacattataaaaattaacgcataaaagtgaaatactcatgtttttatacagttaaatttagaataaatgtaagttttttgaaggaacaaagtatcgtttgtataggagagaaagaatgtgtgtatgtgtttgtgtgtgtgtgtgtgtctgtgtctgtgtatctgtgtttatagaggtggtgaaaatttattaaatccccccaaaatggaactggatatgacattatagtgtatttggtctacctagaccaccttacttgtcaacagatgggagccaggagactttaaataagtatcttaaggtcacatagtatgttagtagcagagcagaactagaacagattttctcattctcagttatcttttctcattactcttcttcttctttagttttatttgttatttgtgataatttacagtgcatttgtgaattgacatgcctatgagacttctgttggcctactttgcttaatcctaagagggctattacatgaggacatctgaattgagaaaggcaggaaaatgtatttaggtgtgacattaatttgtgacctatgaaagtgctgtagcatgcccccatatctaggccttcagtttaaacaaattggttaaataggggctgtggctcccacactctctaattcctaaggcttttctctcccatcccaatgtaagtcaatgctgattgaacctcgttcacttaggagtgtccttgtgactgccttctgggtataaatgctcaagataatgatgacacgtatggtaactgtattctcctgtattctgagagatgaaagtgaactgtgattctgcttgcaaggtatctgtgcctgcttgtattcttccccagcatttcccagtctttctgacttttccatagatcttcatcatttccatagacatttgtcttccttctttttttaacttttacatgtcatatgggagtggcccctgtaagtatcatttgttcttacccaactttctctatgacataagaaaccttttaaatactgatcaaaataattcaggcaatgttctttaataatataaaatataagtattgtgtttcagatgaatcagacatattcgtttagtaggtcagattctccatatcattatagtgatgagcatatagtaggatttatggaaatacttcacttacatttcccttatggagatgacaatagtaagaatttttactttttttcttacctttcactacgtaaggatgagcttggattatttattttaaaatccataattaggcatttccaactacttaatatggtttatataaacttactaggaatatctgttgaattaaaaccttaccttatgtttgattttaaatgtacctgtcttaatccttaaaataagaagggtacatttttttcaattactcctcacttaagaaaagatattcttgagtagttatttataataaggagatcatggactacttacattttaactcaaattcttcttaagtgtttacatttttaaatattgattattgctagaaggaactcatacattaaattggcatactctttttttattcttttcttgccttattttcaattattctataaattagaaaattttttttcttagaataaacaaaatcacagtgttctgagattttgcaaagtctatgtcactgaataacagtgaatatgatttttccttatgaatgagaatattttctctggcaaaaatagaattaaattagaaatcaactacacaaataaatttgggaaaccctgaagtatttggaaatttatgaatatatttctaaaagaggtcacaagaaattgtaaaatattttggactgaatgaagactaaaatccaacatttcaacatttatagaatgcaactaaaacggtagttttgggggaatttatagttttaaatgtctattttagggaagaataatattctcaaattaatatccctagcttaatcttaagaaacttaacaacagaaaagcaaagttattcaaagcaaacagaaggaagaaaataataaagattaagatggaaatatacccaaaagttaattctttaaaaagaccaacaaaactgacaaaatcttacctagatttactacaaacatgagggaaaacacaaattaccaagactgacaatgaaagagatgacatcattaggaccctaaagacattttaatatattataaaaatgttattataataatttagataactagcaaaaatggataaagtcatggaaggacccaaattaccaaagtggggtcaatgagaatttgagagtatgaataaaactataaaattgaattagcaatttaatatcttctctaaaataaaagccctctatctcatggccttattcaaaattctgtgaaatatttaaagaagaaatagtagtaatctttcctactggtaccagtaggaaccataaaaatgtattttattaataggctagtgtaatcctaattctcatatcagacaaatgcatcacaaggaaacacaaccaaacagataaataaacaacaaaaactacagactaatatttttcataaatgtagaggcggaagtctttaacaaaatattaacaaactaaattcaagaacatataaaaagcattatacactgtgaccatgtaggatatattccagacagtcaaggttggtttgtcatctaaaagtcaaataaggtaatacattatattaacagaataaagtaaaaagcaacacagtgaactcaatatacagaaaaaaattgaaaaattctaatagtcatgataaaaactctcaaaaaactagtaataaaagggaatatctttaaaatgacaaacagtatttagttcacagcggatataatacttaatggtagagaatgttaatttaatatttctattaaaatctgaaatgaggcaagaatgtctgttctcatcacttctattcaacatagtactgaaagatctagccagtgcattaaaaaggaaaaaaaagcaattaacagcactcaaattgaaagagaaatgtacaattattttacttctcagatgacatgatcctttatgcagaaaatacaaagagatccataataaactacttgaactaataaacaaatttaccaatgtcataggatacaagattaatataattgtatttctgtgtactttcaaggagcaatctaaaaatgaaattatagaaaaattatatccatgacatcagaaataagatacacaaaaaaattaagaatataatgtaaatgtaagtataatatatattaatatagcataattataatgaatatgaaataaatataaatatgtaaaataacatcacaaactaagaatataaataaaaaagattaaaaaatctgtgttaaaaactacaaaatgttgctaaaacaaattgaagatctatataaatggagagacattccatgttcatgaattgtaagtctccatactgtgaagatggcaattctcccaaaattgatctatacattgaatgcaatttctatcaaaattctaagtaggctttttttggaggtagaaattgatgagctggtttagaaatttatgtgaaaatgttaaggacctaaaacagccatgacaatatttaaaaataagaaaatggccatactgcccaaattgatttatagattcaatcctaccccaatcaaactactgttgactttcttcacagaattggaaaaaactattttaaatttcatatggaaccaaaaaagagctcacatagccaagacaatcctaagcaaaaagaacaaagctggaggcatcatgctacctgactttaaactacaccgcaaggctacagtaaccaaaacagcatggtactggtaccaaaacagatatatagaccaatggaacaaaacagaggcctcagagacaacaccacacatctacaaccatctgatctttgacaaacctgacaaaaacaagcaatggggaaagaattccctatttaataaatggtgttgggaaaactgtctagccatatgtagaaagctgaaagtggatcacttcctttcaccttatacaaaaattaactcaagatggattaaagacttaaacataagactaaaaaccataaaaaccctagaagaaaacctaggcaataccattcaggacataggcatgggcaaagacttcatgactaaaacactaaaagcaatggcaacaaaagccacaattgacaaatgggatctaactaaactaaagagtttctgcacagcaaaagaaactaccatcagagtgaacaggcagcctacagaatgggagaaaatttttgcaatctatccatctgacaaagggctaatatccaaaatctacaaagaacttaaatttacaagaaaaaaacaaccccatcaaaaagtgggtgaagaaaatgaacagactcttctcaaaagaagatcattatgtacccatcaaacatatgaaaaaaagctcatcatcacttttcattagagaaatgcaaatcaaaaccacaattatatatcatctcacgccagttagaatggcaatcaataaaaagtcaggaaacaacagatgctggagaggatgtggagaaataggaatgcttttacgctgttggtgggactgtaaattagttaaaccattgtggaagacagtgtggtgattcctcaaggatctagaactagaaataccatttgacccagcaatcccattattgggtatatacccaaataattataaatcattttactataaagatacatgcacacatatgtttattgtggcactattcacaatagcaaagtcttggaaccagcccaaatgcccatcaatgatagactggataaagaaaatctggcccatatacaccatggaatactatgcagccataaaaaacgatgagttcctgtcctttggagggacatggatgaagctggaaaccatcattctcagcaaactaacacaagaacagaaaaccaaacaccacatgctctcactcataagtgggagctaaacaatgagaacacatggtgaacagtaaggggaacatcatacaccgggacctgtcagtgggtgaggagctaggggagggatagcattaggagtataggagtaatacctaatgtaaatgatgggttgatgggtgcagcaaaccaccatggcacatctatacctgtgtaacaaacctgcacattctgcacacgtaccccagaacttaaagtataataataaaaacaaaaaagaaattggaggaattgccatacccgatttcaaaacttactataatgttacagtagccaagaaaatgtggtactatcataatgacaaaaatataaatcagtgaaatagaattgaaagtcaagaaataagcccttaggtttatggccaattaatttaaaaaaatagcaaggcaattcaatgaaggaaagaatagtattttcaacaaatggtgataggaaaattatatatccacttgaaaaaaaatgaatttagaccctgataccacaatagaaaaaaaattcagaatatagaagaccttaatgttagcactaacactataaaactttttagaaaaagactaccagataatcttttaccttgatttagacaaatattcttaaatgtgatatcaagagcatcattcataaaagtgaaaattaataaacttgacttattgctaagagaatgaaaagtcagggagaatgaatttgcaaaccttatattttatgaagatcttatatctaaaatgtattttaaaaaatcaaaacaaatcaggcgagagattttaacaaattttttaccaaagaattcatgtgattgggtaatacatacatggaaaggtgctcaccatcattatctttcaggaagtgcaaattaaaaacataatgaaatacctctatatatctacaagaatacctataatcaaaacggcaacattggcaaaatgcggagagactagaacctttatgcattgctggtggaaatacaacacttggggagacaacgtgacagtttcctaaaaagtaaaatgtgtacttattacataacccagtaattccactgttatttatatgccaatgcaaaacgagacatacagctatgcaaaatcttgtacaggaatgtttatgacaacattctttatatacttaaacactgcaaacaatacagaattctattaactagtaagtggataaaaatgtatatatatacagtggaatatgaatgattaacagtaaaaagaacaaactcctgtggctactataagatggataagtcctgaaaacattatgctgattaaaagaagcatatgtactgcgtattgtatgattccattcaaatgaaaagtccagaaaagccaaattttctagagacaaagagcagattgcctggtgattgaattttacctatacaatggctaaatttttaagatatgaacattacacccccaaaatgagagacatggaaggagtaatcagagccatttccagatgtaatctcagcctcttaccatagggatgatatggactggaggaaattctcaagaatgtgattattttaattatgatgggaacaaggtaactataaagaatagaaaacaaacattttagagataagccctgattccatttctgtattgaatttacagataattgtttagacactacttttgatcgaaataacatatataagctatttagacttaaaagaaaaagacatgtagaaagtttcctctagttgaacaaaaccttcaactgctttctgtattcctattttgactctcgaaaagaaagaaaatgaaaaggcaaacaatgggtgaagagcttttattcaactacattcttttacctgatatgttttaggttcaataaaagccaattttatgagtttgtggatatatatacacacacacatatatacgtattgagcattgcttgaatattgagacttttggaatgatcaggtatagtaaaataaactctgatatagaggactagaaagaaaaatgactttttaaaaataaaacaggtgcatttgtactttgaatgtacagtgtatgtgtcacatgtttatatgtgatacttatgcacattacttatatacgtatttaatgttaaacatgtaaaatatacacactaagagtacatgttttgtttatattttgctaggttctcatttaatcacaaggaatattaacctaattaaggcacaacattttctttttgccatattctaacagcaaagataaagagacactccagtgtcatgttatatgtatgacagatgcttacagtcaacaattgccactgcaaacagcattggttagcaactgtattaaacttagacgtactgttggtgatttgggtggacttaacagttgtcaaaatttggggtaagtcagttttcatcttgtgagtttgatttttttttttttttagtctgggtcatgctctgttgcccaggctggagtgcagtggcacaatgtggtctcactgcaaccaccacctcccttgttcaagtgattcgtctgcctcagcctcccaagtagctggaattacaggcacgtgccaccacgcccggctaatttttgtatttttaatagagctgtagtttcaccacattggccagggtggtctcgaactcttgacctcaggtgatccacccacctcagcctcccaaagtgctgggattacaggcatgagctaccacgcccggctgtgagtttgattttaatataaagttttctaaccacatgaaagagtttctattgttttgattaccatggctataattgatctcaatttttttcatgcaggcaatattagcattgtgatacataaaatatatactcaatttaattctttgggagtgaccaccagctctctccttaactgactactctctagggataaaaaagcaatttgaggaaatttgggccatgtaaagatattgtaaacatcaaaattgtgagaaacaaaaactaaatataatatgaattcaaattgtgtgtgtatattcacataaaatctgtccaacttccaacagttgaatgactggaattatttctaacttctgagatttgatattggttctatgactaaagaacaagctggaaaggactaccatgttattagaccacccataggtaaaattattttcaaggcttacatagtaaaacatatattttatatatatatatacacacacacacctttgtttgcattattatactagatattgtggctataaaacagaatagaatatgaaatttgtcctcaaggatgtaaaagtacatttatctttttctttcttctcagaacattgtaataaatgtagtacattttcctctgtagaattagtaaccatagtattcatttgaatattcagtggtaatgtgagtttcaatttttagctttataggtactttctagtgactgatataataggtttcagaggcccattaactctacctggtgtccacataagtaatcacatactctgttgtatgaatggcttacatttttcataacgacctgcaaatataaaacctttctttctctccctattagttattctctcttggcacgtaagtagaagagacataatgaaataccaggagttttatctatttgaactcaagtaatatctcccaaggtgacattcccatgggtaaaaaagcagtcttcttcatttttgtgttttaaaacacttatttagatctagacttaagtgttgcttttcttgtaggagtttgaaaatgcttaacagtctaaagttaattattactctttacaaatatattcaagtttctcaagttatctaactggctattcttcctggctggttgcctgtagattttcttagaaaatttgctactttgacagggtagagttacatgatattgtccctactgttgtattctggatgtctctcatgctgccctatcagaatcccgagaaatggcataggaagatcactggagggtacactgagcataaattgatctggctactgccaggtcttgagaatgagaagagggaagagttgctgtgtatgttgagcaattaaagtactatcaaatgaatctgatcacaacatattgcctggaaatatgctatattgctatggcaaagtctattttgtatatgagattgattgttccacatgagggcaggaacttgtctttcataatgagtcagagaagtgacaatttctcgttatatttcagagttatgggggattgactatagtgtgtattctgcagatatgcctcaaagataaaaataaattaaatgcaatggaaacgtgttgatgaatttaaaaagttgttatttaacctattggtatttattagctcccctgtggcttctatgttgagaataaaaagatgaataaaacaagtttacactaatatcttgtcatctcaaacgctcaaaatagtcagtcttaaatgactgatttgatgcttttttttttagtaaaatttaaaacctagtgactaaaagggcattctttggagtggcagagatgttctatgttttgattgtgatggtggttatatgcttgtatatatttgtctattaaattttccattaaatactgttaacatgggtagattttgttatatgaaaatttgactcaaagtaagttgatgttggtcaaaaggtgcagtttcagttacacaggatgaataagttctgaagatctttcatacaacatggtgactatagttaaccgatatcatattttatacttaaagactgctaaaaagaatagattttaaatgttctcaccacacttataagcaaaaactggtaactctgtgaagtaatggatgtcttaaccagtttgattgtagtaatcatttcacaatatacaggcacatcaaaacatattgtacaccataaatatatacattttttccaactatacctcaataaggattagaaaataaataaaaatggtttattttctctctcattatataatagatgataatgtgtaccagtactgctggtaaaagtattataaataatatttgctaatatatattaatgcagttacagattattttccctttgttccgatgttctgattgtggaataattactgagtatagagttaattccaggcttgctctttctctctgtttctttcttctctttcactcacataaactaaaggcataatttaataaatgccctttcgtgtggacctttggaatgtcttttattccattaaaacttagagaaattgaatggtattttaggcctttaacacattgtttaatttactattttcttctaaagaattgggatttcaacaatccaaaggtgcctcaagcttaacatgttcaaaattgaactccctgttgttcctcactaacttgtatcttctgctctccaaacttctgtgaatgataccgtcacttaccagtcacacaagacagaggtctagaattcctctatgcctcccttttcctggtcctttccctatgaactgtattccagtcccatcagtccacctccttgacacttcctggatccattcccctggagttactgttgtgcttccatcttaattcaggctccatttatcttttacctggcctactgcttttctacaattaatacttctgcagcagcaaggtgatcactacagtgtcaaattggttatgtgaactcctaaagtttaatcttttactaatttcccatttcctaaaaggttagaatccaaattccttggtatgacacacctccatggtatgacatggaggacaaggtcctccatgatatgaagcctatccacctcttcaatagcaattatagaacccgaccatatttaataagtttatttaatattgaatacagaatccgaaaccgtaataggttgtctcacacatatataaaataaaagtattataaagaatatttgctaatgtatatttatgcagttagtgattattttccctttgctctgatgttttttgtttttgttcctgcttttgtttgagagagtttcactctgtcacccagtctggagtgcagtggcacgatctcagctcactgcaacctctgcctcccaggctcaagcaaccctcccacctcagcctccccagtagctgtgactagaagcacatgccaccatgcccggctaattgttttgtatttttagtagagttggggttttgttatgttgcccaggctgctcaaacttctgagctcaggcaatctgcttgtctcagcctccgaaagtgctgggattaaaggtgttagctgctgcgcccagcctataatttttaattaatttattttctctatctggaataaccttacacaaaaagggtcatctagtgaaatagctactctgtgccagtgtcaactgcatttggaaattactcatattcctctgagggataaatgaccaactcttccttataccactacagcatcctatttctatacatgcattactttgtaagttctttgcagagcatttccataactgattcagctctgagattcctataccacacctggcatctgacacatggtaaacaccaaatccttgacaagttactgactactatttatattttatgtgatttatttaagctgaactaattatgatgctttcaaaatttaaatgtgtatagttttaacatcaatgaaatccagaagagatagttgaaggaaaggtttctgaggtttttaggatggaaggaagcataggtaaaagatcataaaactgtcagcagctttttaaatatatagagtgttacataaacacatatctgtccataagtagtgatgccataaaattgtctatccttcacctcaaatacacaaagtgtaatttattttttctttaatggatttggtcttccttatgtgatgagtattgggatatcatactttattttggtccatttgcgtctaatctcacattagtctataatgctgtagattcaagtatccctttaggcagtgctgactttcttggttaaaaatcctgtctctcaaccagtacctctctacctccttaccctaaagtggcatctgagggaagggttgacttcctaacctcttagtgctgagataagatccctgcattgtgatgccctgcgacaaatgtgaattccttttctttttttctcctatattcctgcagttgctggtctctctgttggtcataatggctgagctcctaaactgtttgagtccagagtggcatatttcttgtgtgtccagtagagactggtggtcctctcttgcctacccaagctcttcgtggctcatgatggtgacataggctctctgaatcacggcttcaattgttatagggtcctcactgttcaacctccaggccactttgccggtccaactctactctagattaccctgaaatgattcaaatgataccatgtgtctgtttccattagtgaagggtgatgtgatagagcagtcccagtcataatgtctttggagctagaacaagaatataaatggagattattagttttacattaaatatttaactcatgaatcaatctgacagtttgttaaaaatatatgctatccttctaccttgacaaaaatatcttcttaatggtctggagagccagatttgaattgagaatcatctgactccttaaagttctgcagccaaaaaaaaacacaaacaaaacaaaacaaacaaacaaaaaaaacagcggtacaggagaactagcacctgacacctgccctgtgtctaacactaggttttttttcacccctgaggctgttagcatcttgagagcttcaaacaaacatgtgtgaatgccccagcctgtatgttgaaactgtttacacatgctactcctcaggcccagagatgcccatataggtggctcaattcattgcaaagaggaaaaacccagggaatgaactctcacagaccagggcagagggcttggagaggaatgttcagagtcctgggtagggatggattccagacaggtataatatcaataggtaattatggcctccccttggccttatggaatccttgccacatgagtaggagtgagctagaggagggagagagaaccctccaacgtgcagagactgggtgtccttgatctaaggttcatacttactcagttcacagttagatttccataatctcaagtctaaaaggctcctatctaccaacgtcctttcttaaggtcttctgtttaattataccatggtctcgttctccttttatattcttaaaaagaacaagtcactaacacagtctgcctgggaacagtacactttttggtaacatcttagagcagaaaatatatttaaaaagcaacaatataaagaggaaattaattttctttttgtttcctaagtattacttaatacttacaatatatttttcctattacttatataggtattgccatcgacactttgtaagttgtagtaatacacactcataaattcagcagttaactcctctagctttgcacgtaatgctgttatttcttttaaaacacacggttatcctattacgcatgtgaagcttggaataaaatatatattaaaatatgactaaaaataaaaacagattttataggctttggaagtactatactttaaaagatctatatttttcacactgaggaaggagaactactgaaataaagtgtactgtgtcaaagtattacacacagaatatgagaatggcaatattgaatatccttgcccaactgtggaaaattaaggattaagatttgaggaaagtctaaatgcgttaaaatggaaaatgtaggccaggcatggtggctcacgcctgtaatcccagtactttgggaggccaaggcaggtgtatcacctgaggtcaggagttcatgaacagcctggccaacatggtgaaaccctggctctactaaaaatacaaaaattagccaggggtggtggcgcatatctgtagtccagctactcgggaggctgagacaggagaatcacttgaacccataaggcagaggttgcagtgagccaagatcgtgccactgcactccagcctgggtgacagagtgaggcttcatctcaaaaaataataaaaataaaataaattgaaaataataagcacaacattttgtcatttagttgataaatctacagtttagagtttgccatgagtcaaacactatcgtttcccaagtgaattaactttcataataatttgcctttttaaaaatgataattacccattccataatgggtaattacaggtaactatattttaaaagaactcactattactgtttatgtatctactgatttgaaagtgaaaatgtaaaaatgtttttatcaacatcaccaagatgtttttctacaaattctaactgaattgtattctactctataaactgatagacctttgctttagaaacttatgtggaaataccaatccagagaaatcctgtctccctatctcccacctgggactctttagaacctttagtattcacttcaaaacgtctgatatgggaattatagtgtggtgttctttaacttttaatatcacagatcccataatttggagcatcatgtaacattttgtagagctactattcctcagaacacaatttgagaaatgttctaatagagtcattttccacaaataggaaagtcctacaaatattattatactaaatcataatgaaaactagtctgatttgatgtattaattataaagtagtttagattactttaacttttggtgattattgccaaaacttctttcctattaagagtattctacaataaattaaatttagtccacatataatgctgatcatatgtacagtaacattaacatctaagatgacagagtaatatacatcttattacttttgtgaaaaatagaaagggttacataataaaatattaattgtctagaatttggctttctagaggcttgatatactgtgatgtagcccttaaaatatggatgttcttgtcagaaatgtagttctatattgggttctacttttgttgtcagtatgactgggacaggttactggatctctttaggtttgtttactcacaggtaaaatggtggttaataatatcttcctggaagagttgtgatactaaagagatggcctatatatgtaaaccacctggcacctggtagaagcattgattactcttctaccattcattttctttgaattcaattttttttgaggaagtacttcttggtgacagtgaagttccttaaccctcaagaaaaagagaaaactcagattcttggaggaaagaatgtagcactctcttttaccttgttataaaaggttaaattttcccttcagaaatttggaaggcgtggggaaaatttaagggagcaataaagaagaaaagcagaaatctgaacatagatgacaataaaaagaaatgataaatacatgcatgtacactcatgcatgtttgcacacacacatgcacatgtgtacacatgcccaacaaccacaaacacatccacaaataaaacaagagacactggccaggggcagtggctcacgtctgtaatcccagcactttgggaggctgaggcggacagatcatgaggtcaggagttcgagaccagcctggtcaagagaccagcctggccaatatggtgaaaccccatctctactaaaaatacgaaaattagctgggtgtggtggtgggcacttgtaatcccagctactcaggaggctgaggcaggagaattgctttaacccgggaggcagaggttgcagtgagccgagatcacaccattgcactccagcctaggtgccaaaacgagactctgactcaaagaaaaaaaaaagagacactgaaaaaaagagaaaattaactgtgatgctcactattcctgtgaggttgatttaactgctacctgcactgcaatttaatatgatgaacttaagagtacaaggcatctggaattaatctgaaaaattattattagaataatgacacttgaagtgttgacttttgactacaatggaatatttattaactagaacattctgcatacaggcaggaccttgtgaagcaaaatttatagctttgtgttcaggaatgattacaaacaaagatagcagaatcagggctttattagagtactatgcaacagttttgctaaatatatgttaaaggaatctgaaagaataaagagaatcatgaagattatcctaaggattctcctaaggaaattgagctttctgtgctacccagagaagggcccagatggtactggattcccgctgtaacttaaagggaagcttttacaatgtctggaacctgcgatgtcttgaaaatgaaggtagaggatgtcctcaagtttcttacagcaggaacccacttaggtggcaccaaccttgacttctaaatggatcagtacatctggaaaaggaaaagtgatggcatctatatcctaaatctgaagaggactcaggagaagcttctgctgaccgctcgtgtcattgttgccattgaaaactgatgtcagtgtcatgtcctccaggaatactggccagagggctctgccaaagtttgctgctgccactggagcaactccaattgctggctgcttcactcttgggatgttcactaaccagatcctggcagcctttcaggagccacagcttctagtggttaataatcccagggctggccactgtcctctcacagaggcatcttttattaacctgcttactattgctctgtgttacacagattctcctctgtgctatgtggacattgccatcccactcaacaaaggagctcactcagtggggctaatgtggttgatggtggcccggggagttctgcacttgtgtggcaccatctcccatgaacatccatgggaggtcatgcctgatctctacttctacagagatcctgaaggattaaaaaggaagagcaggctgctactgaaaaagctatgaccaaggaagaagaatttcaggatgaatggcctactgtagctcctgagtttgctgctactcaggctgaagttgcagactggtctcaaggtgtgcaggtgccctctgtgcttattcagcagggctctgctgaagactggagcactcaagactgccacagaagactggtcttcaactcccacttctcaggccactgaatgggtaggaacaaccgctgagtggtcttaagctgttctttcatagatactttttttttttttttcctcctgagacggagtatcaccctgttgcccaggctggagtgcagtggtgcgatagctgactacaacatccacctcctgagtagctgggattacaggcgtgcaccaccatgcccggctaattttttgtgtctttagtagagatggggttacaccatgttggccaggctggtctcgaggttcttaagctacatggcaataaggttgttggaaaataaacattattgtctaaagaaaataggaaagtgaaatataaagttatgaatttaaagctatttagaagggcatgaagaaagaccaaagaagtattcaaactgaaattattctaaaatgaaatttcaaattaaatttaatctagtttcacattgctgattaaattttagatgacactgtacaaagctatctgggagagtgaaaccacatgacaaatttactggttgtcattttctactttgtgattttagcctataatcagttttaaagttctgatatttagagtgtgctgcctctctacaactaagacctttttgactttaactttatatctgtttaaagaatcaatatcccttcagaggttctacgattacagattgaaattactttttaaaaagttaacgtcccaggttctattaagactagtttccgaggctgagcatggtgggtcacacctgtaatccgagcactttgggaggccaaggtgggtggatcacctgagagcgggagctcgagaccagcctgaccaacgtggagaaaccccatctctactaaaaatacaaaagtagccaggcgtggtggcactttcctgtaatcccagctacttgggaggctgaggaaggagaatcacttgaatccgggaggtggaggttgcagtgagctgagatcacaccattgcactccagcctgggcaacaagagaaaaaaaaaaaaaaagaaaaaaaaaaactagtttctttaaaatgtggatatcagttaaaatctgtgtattgtattgcattttgaatgcactggattaattccatttttaaatgaaacgtggaaaatcttgttttaagatgaagaatccttgctaaatagaatctctgaaccctaaaatggcttttttaattgggaattttcaaaatatgaatttggttagttacaacaaacaatcaaaatccttacctatgaattgccctcttctaaagcaagaatgttcaactcggatatctagtggtaaagcaaaaagagatttccctgttagtcctcttacaggttgtgggcattgcttatttgactttgaaacattaaagaagaatgtgtttcagggcagacatgttggtaaaactgtttctgttacaaaaattttagaggacaacccaacgttttaatgtggtgaacctcatttatcatcctgtcactgcaccatcttttttcagtttcatcctggaccagggtttcatggcacagaaaaaaacctggccatcaaatcatagcatatgaacaagtagatggccaaatgtttgaaagcataaacatgcctctctcattgggcactggttgagagggttcgaagcccattatttgtaattgcagttcagactaggagaaaaaaaactccatccagaagagaaacgattggaatgtttgtatggatttgggttttgatagcttctgtaacattccatcactgtttgtgtgagcattttccaatcagctgtcccaacatcaaagccatttctgcataatttttttttctctatattgcttgttcttttcaaaatttggttttctatccccttctcccccagtctcagtgagatttgcattttaatgtatgatctgtctaatgtattgtctatttcacttctaacagttacatctcttacatttacaaatgtacttcaccatatttcttccagacagtcacctttcttattattttactgccctcatgacataatattgtaactatctgcagctcttggacaaagagaacctttccagaagagctttcaactttttctcttttgccttggagtatgtctctctacctctattatgttcttgtaagtgataaatatcttatgagttttttttgtctatccataatgataatagaatctgagcattaatatttattttggtggaccatgcacaatttctaaaatccataatttattttcataaccaatattacagtaaattcattaagcatatacacggtttggaggcttattggcttaataggttcaattcatagaaaaggataattcactacctactcaaaagcatcctaccttgagagtcagctaagtggggaaaggaaaaatatgcttttctcttcagacagcctttgtatcagtgtttcagtaacatacatgactacttattgccatttcatttcttctctttgaatattgcctttgcctctcctgggacagtagagttaatcttataggaatacctaattccacgaattccttagaatagtataaggctgtgcagtgattggcccttaccttgctctctggtctctccttccaccaccggcttctgagaggttcgcagtcttacatcttgaaaaccactttcagtttgtgaaatggaccaggattcttctttttcttttctttttctctcttttatttttttttttgagacaaggtctcacactctcacacagactggagtgcagtggcatgatcattgctcactgcagcctctacctcactggctcaagcgatcctctcacctcagcctcctgagtagctgggaccacaggcatacgctaccatgccagactagtctttttttgtttgtctgtttttgtttgttgttgttgttgttgttgtttagagacaaggtctcacgctgttgcccagactggtcttggggtcctgggctcgagtgatcaactgcctcagcctcccaaagtgctaggactgcaggtgtgagccacttcactcagccagaccaggattctttcaagttttggtgacattacttatatttttccctatttttggaatattctccccatctgattgcactggaacagctttctaacatttttttcaaggctttgttaaaccataaaattaaaaaaataaaaaaacattccttgagattaattctcctggctgtgttgtgcaatccttctaggtgcctgcatgctctgtgcttatctttaatgataataaccctttatgtgttttaaatcatttactcattctgacaagcatattcagtaaacaactgtagttatcatcagtcctattttatgaatgtagaaaataatgcaaagaaaattaagttacttacccaatgtctcacagctaatggtagaacaaattttgaagaggtctgtgacaggactgtccattagaagtcgaatatgaactaaaaatgctatgcaatttttaaaaaatttcaagtagatatattacaaaagcagaaagaaacaggtgaaattcattgtactgttattttattctcaatatcatttcaacatatgacctataaaaatgagattttttttatttcttcacactgagttttcatatccagtgtacattttaaacttaaagcagatcttgattcagactagcattctagaacacatgtgcctaattgctacctttgttcaacagcacaagtctttactcttaattacagcacccctctttgtattgaaatagttttatttgcctacctgccccattctactgtgtgcatctttactaggtgaagaatgtgctattcatttctttatttcaagtatatagactagttagtgcctaagatatagaaacaataaatgcttatggaattttgttgctgcagtattgcagtggcttcagagtacagagatttttggatactctttttagcaatcattgtagaattgaaaatctaaaagattcaaaacgcttgacaaaatttctagaaggcatgtatttgcctgttagacttctgagcaggtcatacaagaagattgggaagctatcctggaagttagctgtagcccctacagacagtagaatatgccaagtttccactttaagagtgcatgtaaatgctatgacttttactaaaaccacatggcaatataataaatgaaaatgtggtctaaacgtgttctggaacatttcctaattattataacatattgtattttgttatcattatttagtagaaaaatgggatcagaattagcattgtaatattattttggtaaaattatgaatgggatcatgcctcatacatagtagatgcctaataattattaatctgatttgatttatttgagccagggttagtaagttcaacttctactggtttctgttatttatttgagaacctattcaacttgccatcattgggacaagctgggacagttccttaaaatgaactctattagagtcaaattgttccatctgttttccctaaatgaaagaagattcccttgatgctagtcaatgagtgagggctccttgactcagaaccagatgcaagctttataccagccttccatttcagcccaattacattcttggcagcctgtgagactcatggggtaaactttttataacaattatcaatatcagccaatttttcagaatgggcaggaataaacttcaatggctccaggatgagttttctgtcttccaaagcctctgtctggctggctgccatggagaatatgtaggagcataaaggctgctgttttatgtaacactctagaaatcagctaactttatgactacttagagttttaggattttatcaatctaaattaattatttaatattggcttaggctacttttttgtgacatagagaacattatttttattcctgtgatacagacctccaaggtgtgtgtgtacattacatagcaatgactggagtctggtttattgttgactccctcataaagctattgtggacgaaagagagaaagcatcttactgatgggatatagaatcagtgaaaacctggaaccattgaattcccattgggttagtgtgtgtatattaggatgggaggtttggggaagtagagtggaaattgatggtgttatgagatgacgtcgtgacctttaactcaggaatgactcaatcctgtcaatatctaacaatccctatacattgtgatctcaggtagattgttttgcaatggcaatggcaattatgaacacacactattattcactgaatgttcataatcacaaagggaaattgtttcttaaattgcaataggacaccaagatttttctcaaggttcaagagaaaacttttctgttttgagaagtttgaaaactaaaacaaagaaagcattcatatgataagagaagaaagtgagaagacacgagtcctctgtcctcttagccaggctctaatgggttcagcccatggaggtaggaattagaaaacatcatagaccatatcgacttgaactgcttagaaattcagccacagattttctgaagcgtgagaacggactaatacaaaaaatcacttttgttatgcattagcaaagaacttggaggcattttgcccatgccttatggatctttggaactttgaacttaagagtgatggattagggtatctggtagaagaaatttctaaggagcaactgattcaagatgtggccaggctgcttctaaaagcctatattcgtatgtgcgagcaaaaaatgacctgaaactggaacttatatttaaaagaaaaacagagtgtaaaagattggacaatctgcaccctgaccatgtgatagaaaaaaaaaaaaaaagcccatttaacagggaggaattcaagcaggtggcagaaatttgcataagtaaagaggagccaattactaatagccaagacaatggggaaagagcctccaaggcatttcagagacatttgtggcatccactcccataataggctcagaggcctaggaggactgaatggtttcatgggccaagcccagggccccactgccctgttcagccttgggacactactccccatatctcactctgctccagctccagccagaaaatttgcagcctagtcatttggtagaaaagaaaagccatttgcaggggaggaattcaaacaggctgcagaaatctgcataagtaatgaggaaccagttgccaatagccaagacaatgggaaggccttgaaggcatttcagagacctccatggcagtacttctcctcacaggcccagagacttaggaggtctgaatggttttgagggccaagtccagggccccacggacctgtgcagccttgggacactactccctgcatcccagtcacttcaccactagccatggctcaacaaggcccaggtacaactcaggccaccacttcagaggatgcaaactgtaagtattggtggcttccaagtggtgttaagcccatgggtgcacagaatgccaaagctgagccttgagagctcctgcctagatttcagagaatgtatggaaaagcctggatgtcctggcagaagcctgctgcaggggcagagccctcatggagaacctccaggaagccaatgtggagggaacatgtggggttggagtccccacacagaatccccagtggaggactgtctagtggagctgtgagaagagggccaccatcctttaaaccccagaatggtagatccaccagtagctttcacatttagcctggaagagccacaggcactcaacgccagcccatgagaacagttgtgggggctaaaccctagaaagccacaggagtggagctgcccaaggctttgggagccctccttttgcgtcagtgtgacctggattgagacatggaatcaaagaagattattttggagctttaagatttaatgactgcttttctgggtttcagacttgcacagagcctatagcctctttcttttgaccaatttttccattttggaaagggaatatttacccaatgcctataccaacattgtatcttggaagtaactaacttgtttttgattttacaagctcatatgcaaaaggaacttgctttgtctcagataagactttgagttaatactggagtgagttaagactcggggggactcttgagaagatatgattgtattttgaaatgtaagagagccatgagatttggaaggtgccaggggttgaataatatggcttggatttgtgtccatacccaaatctcatgtggaattgtaatctccaatgctggacctaaagcctgatttgaggtgattggatcaacagggcagattttcctttcgatgttgttttgtgataatgagtgagttctcatgagatctgatgttttaaaagcgtgtggtacctctccactttccctcattctgcagccgtgtaagacatgcctgctccccctttgccttccaccataattgtaagcttcctgaggcctctccaaaagtagaagccactatacttcctgtacagcctatagaactatgagacaattaaacctcttttctttacaaatcatccagtctcaggtatttatttgtagcagtacaagaacaagcaaatacagagagccaatgcatcacatggccagagtagaagcaaaaaagttaggggtaagatgccacacatatttaaatagccagatattgtaagatctcactatcatgaggacagcaccaaggatatggcactaagcaattaatgagaaacctgccaccataatccaatcatctcctaccaggctccacttccaacattggggaatgacattcagtatgaaatttagagagtacaacatccaaactgtgttaatactgttacagaaatactcaacaaaatactaacaaactgaatttagcaacatgtttaagagattatacaccatgacccactgggattattcctgtgctaggatggttcaacatataaaaatcaatcatgtaatacactacattaacagaatgaaagataaaaattacatgatcatcacaattgatacagaaaaaatcatttaataaaaaattaataccctttcgtgatgaaaactctcaacaaactaggaataaaagaaaactatttcaatatattctaatccacacatgagaaacccatagcacacattactcgcaatggtgaaattgctgaaaaattgtccttgaagatcagaaaaatgataggatgctcacttttgccacttctattcaacatagtactggaatttctgatcaaggaaattagccaagaaaaagaaataaaagccttggaaactggaaacaaagaggtaaaattacttctgtttacacatgatgtggtcttagaaaattttaaagatttccaaaaagtttgttagaactaattaaaaacaataagcaaagtgacagggtacaaagtcaatacacaaaaatcagttgcattttgatacactaacaaacaacccaaaagaggaaattaagaaaacagttctatttgtagtagcaccaaaaggattaaaatatttaagaatttagttatctaaagagataaaagtcttgcatacaaaaagctacaaagcattcctggaaaaaaaagatatatattaatgaaaagctattccacatacatggattgagagacagtattgttaagatgccaataatgtccaaaacaatatacacagattaatgtagtccttataaaaatcccaatgattttttgcataaatagacaaacccttcctaaaacttatatggaatcttaaggtatccaactaatcagtacaatcctcaatatagaataacaaagcattgagctcatacttcatgatttcaaaatttactgcaaagccacagtaatcaaaacagtgtggtaatggtgtgttagccctttttttgtgtgttgctattatacatataaagacatacctgaggctgggtaatttataaggaaaatgggatgtataggaagcatggtgctggcatctacttggcttctggtgaggcctcaggaagctgtcgatcatggcagaaggaaaaagggtagctggcatctcacattgtgagcaggagcacaagagtaggggcaggtgccacactcttttaaacaaccagatctcatgtgaactcggagtgagaactcactcattaccaaaaggatggcactaagccattcatgagggatccagccccgcaatctagtcagcttccaccaggccccacctccaacactggggattgcatttcaatgagattgggaggggagaaacagccaaaccacatctattggcataacaacagacatatagaccaatggaatagaatagagggcccagaaataaattctcaaatatgtggttaacttattttcaacaagggtattgagacctcagtgaggaaaagacagtactttcaacaaatgtcattgggaaaattgtttatctacatgcaacagaatggaatgggattgttaactaaaatgatgtttaaaaactagttctaagtgaatctatcacttaagtgttaaacctaaaactataaaacatttagaagaaagcaggacaaaagcctcaagatttgggtttggcagtaatatttcttggaaatgacatcaaatgcacagacagcgcaagaaaatatacacaaattggacttataaatttttttaagtgtgcatcaaaagacatcatccacagagccataaggtaatccatagattgggaagaaatatttgcaagtcatatctatggtaagggattaatatccagaacatatagaaaatgcctacaactcaacaagaattacaaaacaaacagcataattgatagacaaaggagttacatgaatatttttccaaaaagatatgcaaatatccaataatcatgaaaaaagatgctcaatgtcactaatcattaggaaaatgcaagttaaaaccacaatttgataccacatcacattcactatgatgcatactatcagaaagaaagtaaatagaaaatatttggtgatgacgtggagaaactgaaagtcttgtgcactatttggtgggaatgtaaaatattatagctgctgtgggaaacagtatgatgtttcctcacaaaattaaatgcagaattactgtatgatctataaattattcttctggataaatacccaaatgaattgaatgcacggtcttaaagagatttttatgtacccctattcatagcagcattattcacaaaagctaaaatgtggaagcaacctaagtgtccattgatggatgagttggataaacaaaatgtgggatatacatacaatgggatgttattcatccttagaaaggaaggaaattctgacatatgctacaacatggatgaaccctctaaggttcatccatgctaagggaaataagctagtggcaagtagacaaatactgtatgactttatttatatgaggtacttagagcagtcaaaatcatagacacagaaagtaaaataatggtttccaagaagtgcagtaaggaatgaagagttactgtttaatgcgtacagattttcagttttgcaagatgaaaggggttctgaagataggtggtggcaatggttatccaacaatatgaatgtacttaatactgctcagttgaaaacttaaaatggttagtatggtatatgataaattttatattgtgtgcaatttactataattaaaaaatgaggaagaaacacagtttaattttaaataaaaacacacatgtatatatatatataaatttttgatgtgataaaatatggtctcccataagaccaggaggacttaatcaaatttgctccagctttatgaccttctttagcccctctgaaagtcatcactccatatttgctgaggttcgaagttgggtgtgcaccagtctggtagagactagctccacttttagccatatgctgttgtgctgctaccatggtttctcacatttgttaactgacactgacaaggctgaaagaagcagtggcatgcaccttgcaggggagacatgaatgcgtccacacctgaatttgccatgttcagacctcagttatttcccctaatagaacaaattctgatagtacgaggaatgttgagagctaccccttcaactatagcctctgggtgctgcaggccataaccaggtcgggtgtgtgctataagggggtggagatcaagcagcaccatcccctggggcagctattaaaattttcacttccaaattgtatttaaagtctgtctcccattggaattctggctcccccgttctcttaattgtatgatgttagtccacttaattaagttccctggagttcaattttctttatgtaaatataataattttgtttatgtaaatataagaattaaatgagataagtataaatgtctaacaaaatgtccttcccattgtaggtgttaagaaatggccctttcttttaatgtactgcataactgaatttttttcttactgactaggttataggtgccttttcccctcctcgttcctacttcctagggacatggtaaacacttaacaagtagtttattgagattgaaaaaatgtattcattctattgttgcttgttggttctatcagaacactttgataggaacaaaaatggtgattttctatatcatatctgtatctttgaagacagttatctacccttttatcatatttgtgcttccagctgtgccaagagcaaatgttatagagttaaaacgcgggtgaggtgaggcaggatctgcagactgtggctcttatctgcttaatgatgtgtacagtaagtgtcatattaggaagaagaacaggaaggctcatctttttgaagcagaaacataatgttcagtataaagaatctcatatcatgttttctaaaaaattgtatgcgaaaaaaatggtgaaataaaatgcttaaggagagacatctgttctctctgattctttaacccactttagacttggagaagcaaagaaaagcaacagtttaattcttgtgtttctttaggtccagatctttagctcttgcataaaagtgagcaagctgccatctgtgcaaacaggtggcttgaattaaatatgatgctaagtattagaacaattatatttctagcatggcaggaagtgacaaaattaagaaaacccagggtacttttagtaagatgagatatgtgagccataaactgtgtctaagaagataaagtatgaaaatatatgttcaaaaggagctaaacaactgcatgcttcacatttgcctccagtaattcaagaagagatgaagtgcaattactcatatgcccctttcaacatactactgtgggtcaactgggtccatcatagaacagtattagggaagatcttctatgtcatgaataaagagttgctcaactgtggcttaattatcatttaatagtgactctcttagcttcataaagtacattcttcaaagcttgaagctaagtagaaaggcaaaagaacacacaggttggagggtaagcttaaggaagcagtataagcatcgttcattcattcagagataaccggtattgcagtaagtaggctggacttggaatcgtaattcaggagttttagttgctgattcttcactgggttcaatgaggcttttttgatgactttttcatcatggatgaaatgaagtcgttggacaagatgacctccttggttccgtccagctctacaaaacattttggagccaattattttgtcgacttttttctcaggggtcctttatagaaacagtgtataaaatttactgataaagtaattaactctttttgacagttttccttcagttagattaatattttcagggttcatctatcttgtactatgtatcattatttcattctcttttattgataaaaatacttcattatatgaacatatcacctgcatatgattaatgtatttaatattgtcaacttattcagaatataaatactatttgtagagccctatattagtagaggtaaggatgagaatattcaaattaaatgagaaggattacacatagcaactataacacaagaacaaaccatttttgtttcaaagttggtaaaaagttaaactttacttggagtagatgaaacaaataccaggcaaatggcacattgttttgtttcatattacaccagtagtttcggttttacagccaaaatatatctaaagttttgtatttgaaacttttgtcatctcagttgtttccgttttggtcatcactattttttcatatacctttaaaaaataaatttattgatataaaatcatatagcataaaattcacccttttattttttaaaaataatttttattgtgtctatttaatgtatgtatacatcataatgttataagattatatatatatatatctgcatacatagtaaaatagttagtataggggaacaaattagcatattcatcatctcacatagttacccattttttcctccttgtgataaaaacagctatgaaatttgcctttttaaagtgtacaattcattgtttttagtatattcatagaattgtctaaccatcattgctgttcatttctgaaatgagttcatcatctccaaagggaaatctagtacacagtcatttctgattttcctccccccagtctctagcaatcactaatctactttctatttctatggattttcctatttgaacatttcctatagattgaattatgccatatgcagctctttatgactgtcttctttcagttacattcatatttttaaggtttattcctcgtgtaccatgtatcattccttcattcatccttattgacatataaataccaatattattatatggatatatcacattttatcaattaatcagttcatgatactgggatggcttcctttcatcatagccttactaccttaacatcttcttattttttcttttcattatgtgtgggtgattaacctctgggattttactctattcttgctttgttgtctcatccagtttatatatgaattccaaaatgctcaaaatgggaatacttagacactaattcaatgagatacataaataccaaatatatactcagtcttattcaaagtaattgggtaaataaggaaattttaatattttcttctaaaaagagtacacagccattttgatggttaatggtagtatctgataacaggatgaaatgtaggtagggtggagaattaaaaaatgcttactaaatcatggtagttacgttacctccatcatcatcatactcaagatcactttattggatacatactctgtggaaggtacttcatttttaatatgtattatagtatttgatattaaaacaacttattttggacatgtaggatttttaaaaaattatttcagatgacaaaagtaaattacagatagctaatgtaaccagctccaaaattaaatactgttatgtagaagagtcagaatttcaacccaaatctctgaaacatactccttcttcgttctttcactgcctgatatgtctatctgtctgtctatctatctatctatctatctatctatctatctatctatctgtatgtgtatgtgtgtgcatttgtgtctgtgtgtgtaaaactaatattgtttgggaggaattcataattcatagaagaggtggactttcaaattgcccatgatgttagatgaggaaaatttggttaatcgtgatgagaagtgaggcagggtcactagtttgaagaaaacaaccacagcaataaaaaatgtactctccacattcatgttctaacactgattgatgttaagttgtaggtttagagttcagccttactggcagacttacttgtaaattccgactgctccttggccaatctgattattcttaacaactcaacaggagacttgaaactttaatggagatttgtgattctcccagggcgtatatctatatcttctcagcagtgtcagactgatctgctgccaacatgtttttccccctctcagtaaaataaatctctgactacacatcctggcaaaagcacacatttctcctggcaagcttcctcaatgggcatcgaatatcttgagatttcagacaaaatcatttttctccaggggaaacatgactcgtgtagatgacaggaccccagacaaacagcaaactctgctcagaattttaacaattactaaaaacatatttcctatcacagactcatttttttttgccaccagtacaccccccccccacacacaaacacacaggtgcacacatacatgtgcacatagtcaattttcctgtacttacctgcattatgaaatgccaaacttatggtgagtttggagaggcaattttttttttttacaaataataccctccataaataaacatagttattatgaatgcacactcattgtgtaatagatctgtggtttgtgtcacttagccaactttgatcattttctgtcatccagaaaataacttctttcttaacaaccaacacataatcaatgcttggcagtaatgggcatgtgatttaggtttgtgcctaattagcacattgcataccactaatgtacagcacaggaatgagtacctggaccatctatgaccaatgaaagcaagggacctcctactgagaaccctggaaaatatagttttggtttttttatgttgtcttgaaagtgacaggctgtagggattccatatgctatagtcattttttgatcatgaagagaaagcttgtctgaatggagccatctgaaagaaaactatggtaagatattagtcatgcccctgatgacaacactgaagtatctgtatcaagtcatgcatgtctgcatgaagccctacatgcagtcagccagttcgggaggtaatctcattcaggcaggagtttctgatacttcaaaaagcaataaatagtcctttagttttctcccacctcctacctaaaatagaaaatggtaacaatgacttatctatcaattcttagctgatcatccttcttctaaaaacattaacttgtatatcgtgtcacgtgcctgtagtcccagctacttgggaggctgaggcaggagaatcgcttgaacccgggaggcagaggttgcagtgagctgagattgtgccactatactccagctgggcaacagagcaagactccatctcaaaaacaaacaaacgaacaaatattaacttgtataatagctgtttacagttaggtaagttacatcctgggcataagaacaaatatgattaagtccattatacaattttaggctcatcagcattttttcttaatcatctgaatttttctcataaactttaacactgttccaaaaaaaaaaaaaaaaaacaaacaaaaaccttaaagcctacatatgcttgagaagttattttatccaaagaaaaacgacaacctattgcccaaagttattgcctcatttccacttgctattaccttagaactaactagtgttttgatattagtaaccatcctataactatttctttgtaagtattttcatatattttatattcgtgcccttcattcttgggtctgattgttgttaagtatgtgaattttaattattctttctgtcacttcttttaatgttgtttctgtttaaatgaatgcaatactaccaatttattcaactaaatcaattttctatttaattaagtcttactttatggtttaattatatacttggattacagtgatcaatcttctctctagagatttaactgaaatatgcagaaattgataaaggtaaagttatgtcattatgcatttgaagagtcatagcatctgttgtttagatgtatgaattagttttccagacaacaaaattcttcaatactactctatgcaattatgttgagaactataacatctattaatatgttccttttgtctacattttaaatacagccactttttctttgtatatttcagttatgatattgcaatttatttttctttctataatgtcaactgagagtgttaagcttttgaaatagccaatggtgaatttttagtgtttagtgacatagtataatgcctaatctataattttaaggaataaagtctgatctaaaccttgatatgttcatgattgccactgtgtattttataagggaacatattaaaattatcagttagtttcccttgacatgtttgcattacacaaattttccacagtggatttatattattttaaaatcggaaaatataaaaaattattgtctttgacccatatgtctttttcttctatcaccttttgtatgtcaatatgctgatattaaccatgactacagaaatattttcataagggtgagaaaacttgcttaagttttactggcactagtaacatatccatctgtccattcaactgaaatgctaatgagaagacattgcatcttgaaaagaaagacatagctttatcaaagatgttggagattaaacatgtttgtcaattggacaatgtcaacaatgcagtttagatgttactttaaaataagctctattttctgcatgtatcactgcagtgtagagttctagacctttgggatcatataaacacatcaatctttatatttactttatatgagatgctcaagtggaagagaagcatgaatctgcttacatctttcctttgcctggtgatttaaatagactggaccattcaacaagagtgttgagtgtatgagtatgaagtctagaaacttttggtaagagttttaactgaagaaagttaatcagttaaagctggtggttatgctactattctgcaaacaacccttctggtgggaaaatatatttaaaattctagagagagattttattttcctcttatgctatctttttgcaaataatccaaagaatgaaatggtcgtgtgaaaattgctgctattcacattttagctacaaatcagaaaaacatcatttagttgagtggctatcaactgctccattatctagcctgaaaaaggctctttatcacaggaagtaccattcataggatcggcacttccacaagaattaataatgattacttacaattatgatgacttttaaataaaaacgaactttattctggttactttttaggtaaatgcttttattttggatatctaactttatcttatttaccagggatttgattcattttttaaaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgcctttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtagccaaaacagcatggtactggtaccaaaacagagatatagatcaatggaacagaacagagccctcagaaataatgccgcatatctacaactatctgatctttgacaaacctgacaaaaacaagcaatggggaaaggattccctatttaataaatggtgctgggaaaactggctagccatatgtagaaagctgaaactggatcccttccttacaccttatacaaaaatcaattcaagatggattaaagatttaaacattaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggtgaaggacatgaacagacacttctcaaaacaagacatttatacagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgcggagaaataggaacacttttacactgttggtgggactgtcaactagttcaaccattgtggaagtcagtgtggcgattcctcagggatctagaactagaaataccatttgacccagccatcccattactgggtatatacccaaatgagtataaatcatgctgctataaagacacatgcacacgtatgtttattgcggcactattcacaatagcaaagacttggaaccaacccaaatgtccaacagtgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactcctgggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaaaaaaaaatatgtatctctcatgccatgttgtaaaacaaacaaacaaagaaacaaaaaacataccttttagagtgtatggctattttggaaatccaaaagaacagtcttttagttacattgcaatgatcggtgattaacgtttaaaatatagtaagtaaaagatatcttatttgaatgaggcaaacaattaataggctaacacagattccagcaaactttttatttaaagaaccagagggtaaatatttaaggctttgcgggccatattttctctgttgcaactactcaactatgctgttatagtgcataagcagccatgagcaataaatagatgtagctgtgttctttacaaaaacagttcttagaaagccagattagcccaatgctgtagtttatggacccctgatctagtatactgtaaaccaaaaataaaaccctaaggcccccaacagaccaaacagactctctcttggccaagaggaccccagaaaaacctgaaaacctgaattcctggctgtgatgggaagggatgttgaaccctcttctttatatctccttccttttggaatttaagcacaactgaccagcattcaggttaaaatagagatcacaagaataacaaaacagtccctttgtggctaattaaaaacaaataaaaggccatgcaaggcaaaggttaagtcccatcctacaaaccaaaaaattttgtaaaactggcgcttttttttttttttaaattaagctggtacaatttgacttaatttctaacctaactacagatagcagaccctgaaggaaacaaacatattttaccccaaaatatattttttgttatattttgaaatggccccacaaaaccatcttttgtagggaaaatttggatctgcagacaatctctattaatgtaaccagaccttccctttcccaagcctttcccagatctaggggagattagctgacagtctgacaactttaatgtctgaaaagagacatttaccatctattctctctgaggcttcatctgcataaaaagagccttggcctttacaaccccctttaatcttgattcaagcatttatttcttctgacttcaaatatttagacaaagtttaactcttgcaaccaattaccaatcagaaaatctttgaccccactgatgacatgtaaaccttccccacttcaagatatcccacatctttaggctgaacccaggtacaccttccttgtatttatttatagttgtattagcctgttctcatggtggtataaagaaatacctgagactgggtaatttataaaggggagaggtttaattgactcacagttctgcatggctaaggaggcctcaggaaacttacaatcatggcagaaggtacgtcttcacagggcagcaggagagagaatgagtgccagcaggggaaatgccagatgtttgtaaaaccatcagaccttgtgagaactcactcgctatcaggacaacagcatgggggaaaccacccccatgattcagttacctcctaccgggtcccctgacacatggggattataaggattacaattcaagatgagatttgggtggggacacagctaaaccatatcaatggttttacctacaattccgatctccctaaaatgtgtaaaaccaaatggtaacccaactcccttcagcatatttctcagtacttcttaagaatgttccctgggccatggtcactaatattggctcagaataaacctctttaaagtattttacaaagtttatttcttccattaacaatgctaagtttaaatttatatatgtgtaaatgtattaaaaattatttaaatgtaatattgtaacattatgaaagtaggttatgagagttgagatttgcaagatagtattaaaaaatattctgacactaaaacactaaggaagaccttattcaaagcaattgcgagagggctgtgcgtggtggctcacgcccatattcccagcagtttgggaggccaagattgtggatcatttgaggtcgggagtttgagaccagcctggccaacatggtgaaaccccatctctactagaaatacaaaaactagctgggtgtgttgactcacacctgtagtctcagctattccagaggctgaggcagcaggatcacttgaacctgggaggtggaggttgcagtgagtcgagatcccaccactgtactccagcctccagcctgggcaacagagtgaaactttgtttgaaaaacaaaaacaaacaaaacctcccccaaaaaacccataccaaaccaaacgaaagaactattgcaatatagagaagagacttaactccaactacagcaaacactgctagaggtacttagagccaatgagcagaataatgcagtcaatgcatggaaaactactaacaggaggtatccagggcagggggagtcttgctaaactggtataagagttatagaggaaagaaacacgaaacacggctggcagttaaagacaggttttctttagttgaaacctgagaggtgctcctggctagtttgtcaggagccctttctcttacagactgtgagtatatatttgttttagggtgagaaggcttaccagaagcttggaatgtttatgtgtgtggataattttatggtgggctggaatgtctctgggaggagaggagattatcttggggcagacatctcttcagccaggaggagggttgtctcggggctagcatcttcctggctggaaggggttatctaggggctagcatgtctgtggtcggggaggagtttggaatgtttctggttggagatgttatttgtggtttatggtcatgctgaccttagccattaggctgatacactttggatttaggtggcttttattaggttgaactttagaatgaggggcatgtccaagatggcaatgctcctgctctgtcaactggattaacacaatttttgctaaaggcaagccatagacttaaatttcaagggtaggggtagaggaatttgatcaagtgtcaaaggcaggaggattctcactaaactgacccagcaggattcttgttaaaggcaggccaaggtcaagggctagttgtgaagtagatggaggagcctgaacaaattttagtcaaggcagatatcttcatcaggagtgctaaatgcatttctaaataacgtcacaacagcaatcaataaataaataagtacatatatatatatgatcgatgtggtcaaaaacttagaggaaacaaaaatatttgctgtgatcattctactggatggggctgtagtacatactctaaaagctgtgaatgactgaatggtggctcaccaaaaattccaccaaaataacctattaaagataaagcatggctgacttaattgcttagtttggtaaaaaagatcactcttgtcacagaaagtgagcagcatatggaaagagaaaagcaaagaagagttgcttataaagttttgggggtatgtagtttgacaggtatttcaataagtggtcttgattagagttgggcatactttgtgattaagagtttaggataggtgaattgagggatgtgagtgctttggagaagctcttaaataggaaacagtcatttgtttgtgctgtatgttgttctgagaaagatatatttatgagccttagatgggcggtctatttttcaagtaaatgggtttttggaaagttcttgaaaaaaaagaaggttatttgcaacttcagcttcctggaaagaatttcctgaaatattaaagtcatatcaatgcagacagttgaatagcaaattgtgttaatgtaaacagtaagatgtgttggtatagatcgtttcaattctcaaaggaacaagaaataggttccttcttgagtttataaagtaattgaaaacccaaaacaaacacatcaaaatggaataaaaaaactcaataaaaaagatcgaaaggaattacatgattaaatattaactggcacaggagttcagaagagagggatattaggtgaatactttaaaggtgttgggaatttaacaatgctttgaaaaaagtgaaaagtttggacaagatctggtgtatttattagtgggcattgtaagaaaatctgagtgggagtgaagttttacatatgtggagaactgtaagccacagataatctggactattttataggctatcggtagataataaatatataaatatatgttaaattttatattttattattaggaagccacaggtctttgaggagtgtttgagataatggtaagtattgtgttgaattgattgggctgtgtaatggtaatacctagagccatagaaaactcttacaaaactagcagtagtctgggtgagtggtcataaagaacaatataaatataggagatgaagatacaggaaaggtgtaaccaacaggatggtatgtatgtaaatggaattttgagggagagtagagccaaaactataaaaagtttaattgtagtactgagttttatatgtctacaagatatgtgatctagcatagaattagaaatatagaactggcctatgggaaatgtcaggacattagttgaatgtttaagaatccatataagaaggtgtgagtagtaaaatagtcactgaagagctgttggaaaaaaaaaaaagcctacagctgagtttggaaggatgcctttgtttagatagcaattgagaggaaagagcatatagaaaaatttgaagaacaaataccagggcaagatagtggttcaaagtcaagagaagaggattgcaaaaccctactgttcatcatcattgttacacactatgaagttgagttaggtggatattaaacatgggggaagaacatattgtatttggttattgcaggtcagtgatgatgctggaagtctgaaatttcagtagagcaaggactgcagctgtactgcagaagatacagagaatagcttgtatggctgttatggagaacaaggtggaaacccctcaggcaaaaggtttattgaggcttactgtgaaagggaaaaaactaggaacagagaaaaacaccagacttaatgtactttttatttatttatttattttttgagacagagtctcactctgttgccaggctggggtacagtggtgcaacattggctcaatgcaacctccgcctcccaggttcaagcgattctcctgcctcagcctcctgagtagctgggactacaggtgtgcaccaccacggctaatttttttatgtttagtagagacggggtttcaccatgttggtcaggctggtctcattctgttgaccttgtggtccacccacctcgacctcccaaaatgctggattacaagcatgagccaccgtgcatgtactttttttctttaatccttttgttttttgaagcagaaataaaagatatttaagagcttagagcgcattgacttgtttataaaacagagcttctctttgcgaaggagaaagttcatctcttcccaaaagtcttgggaaaaaaatgtgcatgcaatgagatcttgaagtagaaataaaggatattgaagccatttctaatggcctcagtttcttcagttaaatatatggatcctggggctcttcaaaatatgaggaaagtttaacattgttgtgagcagtgttttagggagttgaattaggagcctactgtgttttaattgtgagtagctaaatattctagatttaccattgatatatttaattaaagaataaaatcttgttgtttaacaaacccttcctagatttatttgagcatttcctgtgatagtcatttcattttttccacattttatttttaattgctcagctttttttattgagtatagtttcttttaaaacatggaatgctacagaatttcaattgtggatatatcaaaaatagttttaaatgaagattatgtttggattaaagtttctcagagaactgatttgccagagttttttctactttttgaaaactctttctctatgtagagatagattatatatttattgatttaattttaaaacactgaaactagattatcacgtcaaaattaaatgcatacttaaattagccgttagcaagaccaacagaaaccaatatggtgactttttattgttacatatggaagatgaattttgtcggatttcaacttctcagaagactcacagcataacccgttaagcaaagctgagtttattacctataatagtcagaaaagacaacattttacaagagtcggagtgtccagaaggagaggattaaggcgaaatatgaatagggttggaaatctaggtttgagtagataagactgaactttcaatgtgaggatctggtttggttaggcacatttcaagacgtaatagtttaggattggtgaacacagaaaggcaggaatcttgaagtgagttgtttgataattgagccatttacccagttttaggagtttaatgtttctagaaactaattttcagccattttctgaaaaaaaaaaaaaaaaaaaagtttttcgttctgatttacaacgttaagttcataaacaagaacttcctagaacaaacagtaaaataatgtgaatgtaggctgcctttatttttggtcctgatagataaggtggatgcagaagtctcagttcttaatttcaataccacattgagaactaaattaacaatggaaaatgctttattatctgctttgtgtggaagaggtataaaatataaggctgcatttacctgaaagattttaaattaggatactatgtttttctttttgtcagccaaattatgggaaaaaaaattggatcgaaatggcagtaatgatagttagggttactgcagactgaaaatacgtgcttagatctcagggtacacaggccagatagtgattctattctgccatacattttcattttaggaaaactgactgagtcgaatgtgtgttcagaataattggctcttaactgtcaaagagttaaaaaggagaaaagattatttaatcaaagtaccttgtagatatgcatagtgccatgctttaagaatatttcaagtactcctaccttaatctttccatgttaatgcacttaagtcattgatctgattcactcatatttgattacttaaagttaaacaaaatatatcatacaacatttagaaatgtagttccagaatgaaggatcactattagtctggtagataactgttaatctagtaacaggagtttcaaaactggggattccactagtgattataaatcaaactgtaaagtaggataaatatgaaatccagaagaccagattataaagaacaaaaaaaaccccaagaaaattaataagggcagatattagtttcttttaaaataattcatgcaaaaatctttattatttattaagctagagaattacatgtgaattttaaaagtttatcctattaatgcaacattgagagtctaacagtaaaatttgcaggagtgtagatctaaaggtatttacaaatctcaattctctgtagatttttctcaaggccaaataattatccaagaaaattgactttaaataaactgatattaagtgtagtctttatcttttcaaacaagcttcacttccttctactttgttctaagggaaatcatgatgaattttctttcgatcacccctaataacaacctatcactcatttaagattttctttcactatgaggaactatggggtcacgcatttctttttctcttctcttgactaggaatcaccattcatactaaaattgctctatggcttttctttctctctaacaccacagacctcatctcaatttaaaattctgcattgtgcttgtgtactcacccaatgatttcttcctatccactgcaaaaaccagttcactgagacgttggtattgcagtaaagaagagtttcagtaacatgagattagccatgtgggagaactggagttattactcaatgagtttccctgaagtcttggaggtcagggtttttcaaggaaagtttggtgggcatgggactagggaatggatgctgctgattggttgggggggatgcaattataaaagtgtggaaaactgtgcactgagtctgcctctggatgggaggtcacaggactggttgagtcatgagtccaggtgaggccagtctgaaaatcatctcagaagaccaacctgaggttctacaacagtactatcatctatattatctatatataggcgagtcacaaatcttgtgacctctggccacatgacttttgagcagtaagggattatagaaactatagctacattttaggagaattcaggcctctttcataatttcagttttgtgtcctttcattagtattacaagggtggtttcaacccctgaacgaggaggggatgaggtttagggagggactattattattcttgtttcaaggttaaactataaactaaatttcaccaatggttcgcttggccaatacccaagaatgagtgaagacagccagcctacgagcctaaaagcaagatggagtcagccatgttagatttctttcattatcataatctttgcaaagatgtttttgcctgccttttgagagaaaagctacttgtcgagtgttttgttttgttttgctctatttatctccatgatgcaatggaaaatggaaatttattttctcttaatttattgagaaaatattgtaaggatgattttgttagggcatgctatttggctcttgataattcatgatgatatgttcatcacaatcaagaagtgggccagagatgagaatattttaaaaaattcatagagggaatagaagttagaactcaaagttgaggttggactgttgatttgagcaagcattaattgtgagcaggaggacaggagatcaaatcagctggcaagaccaaatgagcattacagatgattggtgttgctgttgagacatgatcataaatatgaatgaaaaggaaaaggaagagaggaaaagaatataaatcaaaataaatatttattgtttatgtaaatctgttatttgttctgcatcaacagaaaggaaaacagataaagttaatgataaaaaaaaaagaacccaattcctttttagctgataaaagaagttcagaaggtgatacaggccttaatttaaagatcatatagaactatcagtccatacggccagcctcagggagtaactgggaaatcccttctttatctccttactttcctccttcctaaaaagtccatttgactttccctgtttcccaggccacagttccaacatgtcactgttcccatgtgattaaggtcaagaactactggccctctgtgttattcttgactctaacaggagagtcatattggactatgtgttttgaattagatactgaagaaaacaaacttcagctttgctaatatttcttgcttcttgtcatataaattgtacgtgtaactattaataatatttaaataatgagagaaggggtcagaaaatcttgttctgccaaaagtgtcagacaccttttcgtgtgtttttgtggctaatctttgtaactcatcatttagtacttgttttataactttgcaagtggagacattcagtttctgagagattgtaacttatacacattcattcactataagtagtgaatctaatctccattaatatcacctttcttcctagaatgagcaggagattagggatgtgtaagcaagaaaaggctagaattgggtaaaattgggtaaaaagattatgatttaaaaagagaacatattcaaacctactttaatgtggctatcttctcttttacctaatcatatatatatatataattatgtataattatatatatatatatatttatctccagagtatccttatatcctgtcagttttacctcgttagtaatttcaggcagagatattgttaagatgttttaattttctaacaaatatggccaaacttacctcaaaaatatgtaaaagcaattatctgaaagaaatgcaattatttaaaatgaagacatagttcttctagagttgaaaaagttcattcattgatatagtagtagcctcagattttgagctgcaattgtgcaagccaggtaaaataccacagaaaaaattcacaacccagaagagaattcaagatgctgaataggaattcagtggtggtagaagaattggatccataaataggtctgcatgagaatgattcaatcttaggagacatagaactgttagagttacagtcaactggcagcacttttaagttaaaatactggatcatcatcagtaatggtttactttagagactggaggcacttctctttgcccattttttctcaccacagaatgtgcagcagactgcccatattttaattaattttcatttgttaaaccatgaacctgagtggccctcatactaaccccttgttcattgcacaatagaccatgtgttaggcgggcttcctgatctttcacgagaatgaatgccaagtacagaaatctgcttgggttattgaaggctaaaaatgattattctaatgtgtctgtttattttgcacgttttctcccctacagttactatattatctagtcaatgtatttgtcaattgtgaatgtctttgttgttgcagatacagatgtggtgtataaaagcgagaatggacatgtcattaaactgaatatagaaacaaatgctaccacattattattggaaaacacaacttttgtaagtaatgaataattaattactttatgcatttcagtactgtttagaaagctctctagatgtacataactttctattcttcagctccagcatttgtaaagcatttcaggtgaaaagttggggctggaatatcataagaatcagtaaatctattgataaaaaataccctgtgactatctgcttcattttcttcccgtttactcttgttaataattggagaaatatttccaaaaatagtagttgcttagaaagaataattttcccaatattttatatataacattagtcatacaaataccaaggttaaaaacaatggctcatctagccttatttattattaactttcttttcttctttacttttcattctttctgacttctttctagttctgttgttttctggatcagatagaaaggctttctaaaggtggtcttcagctgaggttgatgtgttttagaatttaggattctgtcagtaccattttacttattttgtatcactgtttcgccaacatggtttaaattattgtttgtatttatattggtcttaatacagactttgtctttctgaaaaatctagtaccctaaggttaggagacttagctataattacctatttggtaagcaataatgaatcagtattgcaaatgttgaaaatctagctacccaacaccaacgaaaaatagtacacagttatttacttactattttattgtaattaaagtttcaatagactgccaattagatgaatgtatacaatacagacaaaatatagtacaagctctcagaaaacctccacaaaataaaaaaataagcaaaattgttggctacttttaaaaatgtattctacttgtacatttaaaataaacgtttaatcttcgtatttattatggaatggccctatggaaaaaatggactaagaatattctgtttagtatttttacatattaaggagaaaaggtcattacaatcattaagtgattatatatgtatatcattgggctaaatttaaccagccaactaatgtacattaataataaggtcatcagccagaagaaaaataatgacatttttggttttaaactaattacagggaatcaaagaatagttactttgtgtgcaactctttatggtactcgtgggatgtcaaggatatgtacagcagattgcctactgtctaagaatgtggatttcctttgggagataatactaacccttacggagaattttaataaacagtatacagcagtgtttactatttcttcagtggatggtcctcagggatactagaaaaaagcctagagaatcattgagaaatactgtcaatagtggaaaattagccattagtaagaagataggataggagacagaattccagaattgataatgatgagaaggtatgatgataatatatggattaaagtcagaatgaatggatttttaataaaattagtttggggaacaaaaattgagtgcattttaatttttgctttttcttcataaagtaacataattttatggagattctaggccctcagtagccaagcattcaggttagatatactcagtacatgaattattctattatgtggctgtgcctcattaaatactcatttacacaagtcagtgaggttttcccccatcactaattatgttttggttttccattatttattcattacttttttatcttccatgatacatcaaaaaagaaaccaaaacaaacagaacttttagattattattccattatctcaattcttttgctggtactacacaccatcaccatctcatatcattgtggttttctccatgtgctaattattgctgttttatctttgtgtttctgtgttatatctttttaaatccttttgaggtctctttctattctcctctacattagccgtgactcttaattaccacagggtcatatttagcaaatattctaatttacttgtcttctaagattcatatgctccctaaggacatttatgtcacaacacagataattaagcaatttataagtcctagaggtgtctaaattcgatgtcgggcaggggttaggggagtggaaggtggcatcagtttgcaaccagttacccaaaactgagaacaaaaataggaattaccataattccagatgatttcaaaggagcttgtttaatcattctctcctaacttcaaaatggcattatttaatacacttatgtttttaatactaacgttaggctaaaaccgggatttaatttctcttccaggaaactctgttgaaaaatatattttattgaaacatattgctggtttttctgtgagcaattatcaatatcttaattataataataattaattggatcagatcagtataaaaagctttgaaatgaaagcatgacaagtcatttgagaaaataaatatactattgatgaaaatgtcataacagaatggcctgttctatagtaagacatattatgctaaaatatgactacaaatttatttttaaaattaagataatttgacatcttaatttatcttatgatatcttgtttgacatcttatcacttttcagcttaaacacattttaaatatgattggtgtgtacttttggttatgtaatcatggttagcagactctatgattaaaataaatattgggcatggttgccaaaataaaaaatacttttttaaaaatgaaataattgtgttaaggcattcttttggattgaaggtaggtggatttctaatgaaaggaggaaattaaagggcatacaacttttgaattagaggatgggaagtaagtggtttagcctcaaaaatgctctttataatttctaagtgtttggaaatgttatctcttaaagccagaactatttcaaacaaaagctcagtcacaatgtcataatgaggaaactgtttcctaagtattagctgtactctttctgctgtcaataatctgaatatcaccagtgaccacggctgaaaataccggcagctataaattgttttatcaaatcactttttgaaattataagggggttgtaaacataagtccaagccccatgtgcttaagtatagttaagattttaaaaatatgtatcttttttgttttttaagacacaagctcttgctctcttgcccaggctgggatgcagtggtgcaatcatagctcactgcagtctttaaactcctgggctcaagtgaaccttctgcctcagcctcctgagtagctaggaccacaggtgtgtgccaccaggctcggctaattttttaaaacagtttttttttttttagaaatggagtctcactatgttgcccaggttcatcttgaactatatcctcaagtgatcctcctctggtggcctcacaaagcactaggtttataagagtgagtcacagagcttggccccctagaatatatatcttatgcattaatatgaaaaggaataattgagagataagactctaatctgaaatctctgaaactctgtaagcctatttaaatacattctactaaaaaagtagccataacacaggaaggaaattcatatatggcagcagaatgattccaagcaaaatgttagttacgtattcattggtctaagtgtttatttatatataggcaattacaaaatagtaggtttgggaagaaccaaggaagattcattgatttataatgcctagagacagcatcagctggcttcgatgtcatcctagtgtttttcatttggtttctttgttgttttatttgttgtgctgttgggtatatggaggtgatagatccaactctgtaccgctgtgaaatcaagaaacttactattcagtttgtgtttgagtaaataggtgccctattgaaacaacaacaaaaacaaacacagtagcacagataaagaattactgaacaaaggcaccgacaattgtacctcataaaatttgagatgaggaaagattatcagaaaattcgattggccacgtagcctcacataatggccaatagtaatggatgatttgttaattatttgtaagatttggtctactcagtatctgttggaatcccagtagtgatagacatcagtagtgtaactaacactgattaatcagtgaagctgtgcatatcaatgttgtgttttgacagtattgtttctttctttctctagagcagtgtttctccactgggggtgattttgctcccaggagacatttgtcagctctggagacatttttgattgtcctgaatgaatgtgaggggtttgctgtgggaatctagtgagtagaggtcagaaatgtgcatcctacacttaacgcaaccagaaatgtcaggagtgtagagtttgagaaaccctgttctagacagagatacaagagaaaccctgtgataattagaaggtaattttctgaggtgggatcaaagtaatgacttttaaattgataattttaagggagatattaaactgtggcttccaggttcattagtttcaggtacttttcttcttttgaataaccctgcaaagaagaccagcatgcatgagtaggatcatttggccttggcttcctctcttgtgtgtattgctgagtataaaataaaagtgtgacccagttttcttacaatttttggatgatacttctgattgggacttttttgttcagataagttagtatcacttatttggctattgccaactttttttttttttttttttactaggaagcagttgttcctttttaagatagaggataaaaactgatggctactggggactccagtcagcataattgctttcattggtgcattgtgcttatgaataattgaatttcatcatcttttgcttgggcatgtccttcccctcgctatagcagttaccatttcctgttgctagataccttcatatttatcttatttttatcattcactatgaaaatatttagatacttattatatccacaatatttatttaaaaatgattatttatgtttgtttacattatttaggtaatatttggaatatttccaattcagtcatcaaaataggatgtaacattgatgtacattcagggaaacaaatggaataatacatgtttcagcaaagattggacacctttctatatttagttagggaaggaaacattgaatctaccatagacatttaggctcttcaaaattttctgtaagttagatatatgtgaaagtgaattccagcatagctttaaaagtagtggtcattaaaacagggaaattagaaagaaaatttctgatccttaccctggaagtctactcaggcactattttaattaaaagtgtgagaggaaatagtcttgttgcttctatgtgtttgcaagtgtgacaggattaccctgcagtttcaaacagttattcatacagttccccataggtttaaagggctaaaattgactactacattattattttttaccctcaattaccattatgaaggatctagaaattagattctactaactaatttattcatgaggacaaagtatctcagatggtaggaccattttattgtcaataatcatagtgttactaataaatccacattcatagccatttattatgcatattgttaaatgagtaagtcatccttataaacaaagttatctaagtaatatataaataaaattatctgagtaatataaaaataatattaaaaataatataactaaattgtttccttcagataggaatacaattatgacaaaaattaattagatgacacttgtttaattatatgaactagagcttggttcaatcttgtctgacagagcctattagatatatgtgataaaaggattacaattccagtgttgatttttttagaagattcttatttagtctctttggagctggaggtgtcagacaggatgctggaaaccaacaggcagctagatttataacaactgtttgcgattgttttggaatttggcttcctgagaggtcagctctctgacgtgtatccagaatcagtcagtccatcttgagcaagtcgaggctctagtttaaacatttgatggatatttctgcccttcattttcttgctgaataattttatatattgctgtctcccagtcatagaaagccaattagaaatttttaaaaatactggccaaaggatacaaagtgtcagacagaaggaataataagctttagagaaacacaacagggcaaccagagttaagaataatgtattgtgtatttcaaaattactgagagtaaatttcaaatgtcttactacaaaaagatgggtatgggagctgatgaatatgttaattagcttgctttaatcattccacattgtgtattcttccatatatatcagaacatcacattttaccccataaatatatacaattatagtttataaactaaaattattaatacaaataaaataataaaacactcagtgttttattactttatgatggaacttaagcaaacaaaatacattttcgagaaacttttcaagctttggaagttgatgatataaaaataatttttcccttcttttgatctttcagaatacttcagtctacacagctttgatgatgtagaactatgcgttgccaaaacttctgcagcccttccacacttcacattacataatacagatattttaatagtatattggaaatatattaaattagtattttagtttgcttgtgaaacatgcgtgagcattcaaggaagttcaatttttggtaaacattaaatgataatgacagctcattatagagctagaaagcattttccctgtctcctacttcagttgaaatttaaaaaagtaaaaaatcaactgagacccagagaaataaagagacttgctcaataaatctagtgtagtcttgagactaaggaaaacatttcttgactcctaatccattgttgtttttaatattactagctgagaattccattcaaaataccttttaaagaaatgtgaaaataaataatgatcctttagttttttatatatataaaaatctatgtttatttgtggaatttttacttaaaccttttaggaaagatgcttgaattaaatatatgtatgtttgtatgtatttattcatatgttcacataatacagatagaatagatatctatgtatagatctatctatgcagatattgatctatctatatctatcaatcaatcaaccagtctatccattttactaccagataatcagtaaggaaacattatatagtgagtggaaaagaggaaaactgtgagtgtggtttacatagctttgtttgccttaacttgtctgaagtcatcatatttgtttttaacatattttaaatattgtgatgactataacctgtgtcatcattctttccatccaaatgttttcaattattgttgaaatattgcctcgtgaacaaaggataacaaccttggctgcattacacacacacgcacgcgcacacacacacacacacacacagacacacacaccccaccaagcaagcagcacctattattatgaactactactctacttctcttctttcccctgatatatctggctgaaataatctagtttatatttgaatttcttctgtgtcttaaaaacttgtagagatttttctacttctccatctttatgatgtttctgcatcattgttgaaatgactcattatgccttattactttattaatttatttgccaagtgttgtttggatccctgttgtgtgtcagataatattccagattctggggatacaatggagagcaagacaagtttgtcagactgacaataaatgagtaattcattgaaaatacaagaaaatgtcagctagtaaatttaaatccttgttgaaaaataacatagggtgaggtctagagaatgattagttgcttaggaaaggctcactacggagataacatttcaaggtcaaattgaagagttgtgtaggttgcaaggccagtaattacaaacaacatagggttcaaactatatagatctattccaagaacagaaaatatgtaagtggtggacatgggtagagaatggtacaagatgaactcaatgagataactaggggaaagatttatactgagttttgtaggtcaaggttttattttgtgagcagtaggtacactctgaagaaagaaagtggcaatacctaagtcatattttaaaagtacactctgtcaattatatggagagcattttctagggatattaaagtagaaactgagagaccattctgaaggctattgcagtggtacaagtaggagaagatgcagggtgtgaactatgtacagggatgctattggagaaggtaaaaagtaggtgggtggaggatttgcttggagataaaatgggtagggctttgttggttaattaccttcaacttgttggaaatagaggaatcagcatcatctctgaggttttaaatgtcattaaatgggtaattctattttgaatattttgccacaatttttgacaatggaatctatttcatggttaggtcttatatgtacatgtttatgcatgttttctgtgtataacagtataacagaggaatttttagaagcctggttgaaaaaatcttgaaataaaattaacaaatttataataaatagaacatagacatgcaatccattgtctcttggggcttaaaatatattatattgcctatgattatttgattcaatgactccataatattttatatgctttttctgtcccaactacaactacagctgaagatacaatagaaaataggagagaaaataggagagctcctgccataaggaaaacaggagagctcctgccgtaaggatctcattatgtattaagggagatatgcactaatcaaataattagatatataaacatttacaatttatgacatagaataactgcaaagtataggaatataagaatgaaagttaaatattgcttttacttttattgcttaatatccatgtcagaatttctaatgcattggctgtatctgttttaaataagtcacggaaagctttcctaaagaaatgaagatgagccgggctcaatggctcacgcctgtaatcccagcactttgggagcctgaggcaggtggatcacaaggtcaagagattaagaccatcctggccaacatggcgaaaccccatctctactaaaaatacaaaaattagctgagtgtggtggcatgtgcttctagtcccagctactcaggaggctgaggcaggagaattgcttgaacttgggaggcggaggttgcagtgagctgagatagcgccactgcactacagcctggcaacagagcgagacttcatctctaagtaaataaataaataagaaatgaagatgactgcagataagttgactaagcaagaatatggcttgagcatagtgggacaggcatgaggcatggagtattagaaacaaagaatgccatggtagtgggagcagcacaaggaagggggaaacaggttggagaattaagtagtggccagatcatgcgggtcatggtgctaaattttcaaaaatgatcagatttgcttttggaaacaaatatattcccgttgaagtgagaaagtaagttaaaattgaaagttgtggctcaagaaaggacaaataaagacactagtggatggcctaggcttgagattataagcaaatggacttaggcagtgccagcagagaagagaaagatttggacgataataataagtaaaataaaaagaaagtaacaaaataagaatgtagtggttggtgatggcggttagaatgatgtatcagggataattcttgagattttggttgtatgacttaaatgaaaggggagttaaccattgagatggggaattctgggtgagaaccaggtttgagcgtatggttggatgaaaatatctgttaaacggcatttagtaactaagtggggaaatctatcaaacagtatttagggtgtcacatttcttgattcaaatgtgaaaaatgaacctttaagttaaaaatagtctccactcctaggtggaggttacagtgagctgagattgcgccactgcactccagcctggacgacagagcaagactctgtctcaaaaacaaaataaaacaaaagaacacaaaacaaaacaaaacaaaacaaaggtagtctccacttcttaaaaagaaggagcagagttgtggatcatatggtaattctgtattagcagtttgaggaacttctaaggtggttgcatggatttgccttcctagcaatggtataagaggggcttgattaattcacatctctacaaaacaggttcttacctatttgattttagccattttagtgggtgtgaagtaatatcttgccatggcatttatttgtattcccttaatttattgatgatattgaggatcttttcttgtgcttattgatcatttgtatatctttgttggagaaatgtctgttcaaattctttgcccattttttattgagctcttttcaattgctgaattgtaagattttttcatatattataaatcaaattccttgtcagatacataagtttcaaatgttttctcccaggtatgttgtctttcactttctgattggtgtcttttgatgcaccagatttaaatgttgataaagtcaaatctattttttctttagttttctatacattgttaatttagactaacttctttttgtgtgtttgagaacataatagatttttatttctatgtttagttctatgatacattttgagtggattttttaatatgatgtgaggaaagaggtccacatttattcttttgcatgtggaaatacaattatccatgtaacatttttgaaaagatttttttttctgttgaataattttggcacccttctcaaatgtcagctgaccacaaatatatgattttgtcttgggactctgtattctattaatctatatgtttatccttaggccagaagttcagtcttgactgttgtagctatgtggtgagacttgtaatcaagatgtgtgagcccttgaactttgctctttttcaaaattggatttctgtgtcccttacatttccatatgaattttaagatcaactcgtaaaatttgcaaacaaagtcaaaagaagctaagacttttgatggtgattatattgcttatgtagatcaatttgaaaaatagtgctacactaacaaggttctgatctgtagacatacaatgtcttttaatttatttagatattattcagtttcttaaaagaatgtgttatatttttccatctaaaaatcatacttttattgttgaatttgttactaggtattttattgcttttgtggccattataaatagaattgtttactccatttcatctttaaattgtttgcagctagtgtatagaaatgtaatgatttttgtgtgttgaatgcttatcctgccacattgctgtatttgtttagtagtccaggctctttatactcataaggggttatcagtctgtagctttttccaactatgtctttgtctggttttgatatcaagataatactagcctaatagaataagtagcaaattgtttcttccttttattttttggaaaagtttatgaaggattttttttaatgtttcatggaactcactgatgataccattatggcctaggcttctttttcacaggaagttttaaatttatttcatcaatccttttacatgttataagcctattccaaatatatattacttctgaaatttatgtctttctaagacttcttgttttgatctaaataactgaatttgttgataagcaattttatagtattctgttacatgttcatttctgtaaggttgatactgatgcctcttctttcatgcctgattttagtaatttgaatcttgttattttttctcatccatctatctagaggcttgccaattttatttttcttttcaaggaagaaactctcagccttattcattttctccattgtttttttagcctagatgtaacttatttccacctaagcttttttatttccttccttctgcttgcttgtgttagtttccttgtttttttcctgacttctttaggtagaagtttaagctattaatttgagatatgtattttcttcttgcccttttttcttctttcttcttcttcttcttcttcttcttcttcttttttttttttttgacacagggtctcactctgttacctagtctggagtgtagtggtacaatcatatctcactgcagcctcaacctcccaggctcaagtgatcctcccacctcagcctcctgagtatctgcactacagatgtgtgccaccattcccagctaatttttttaaaaaaagttttgtcacactgtggtctcactatgtttcctaggctgatcttgaccttctgggctcaagtgatcctcctgtcttggtctgccaaagtgttgggattacaggtgtgagccaccacacaagacttcctccctcccttccccactccctcccctctttccttccttcctgtctccctccctttcttttcttctcttctatttttctttctttttgacaaagtctcactctgttgcccaggctggagtgcagtgttgtgatcatggctcactgtagccccaatctcccaggcttaagcaaccttcccacctgagcctcctgagaagctgggacttcaggcatgagccaccatgtctagctaaatttttaattttttgttagattgtgtcatactattttgcccaggctggttgtgaacaacttaccccaagcaatcctcccacctaggcctcccaaagggaggattacagacatgagccaccgcacatggcctaagattacagatatgagccactgcacctggcctctggctttttctttctttcttcctttcttttcttttcttctttctttttttcctctttactttctcactctatttcgttcctaatatagatttttacagctaataatttccctgtaagttcttctttactatatatcataaatttttgtattttgtgttttcattttcattcttctcaaagcattttattatttctgttgttatttatttcttgattcattggttatttaggtaactgttgtttagtatctatatatttgtgaatttcccaaattgccttccattattgatttttaatataatttcatttgggtcaaataacatactttttataatttcaatacttttccattcattgaaacatgttttgtggcctaacatatgatctcacctagaaaatatttcatgcaaacctcataagtatgtgtgtattttctgctagcatttctgtctgtaagatctttttgctttagaatgttgtttgtcttctattttattactgatgttctgcctactggttctatccattgctgaaatcaaggttttgaagtctccaactatttattattaaattgtttattttccctttcaattctataaatttttgcttcatatatttgtgagctctattattatgtgcatacatatttataattgttttatttttctgatagaatggcccttttattattgcataatttttatctttgtctctagtaagaatttttgccttagagtgtatttcatttgatgttagtgaaaccattctatccttgttttgtttaccagtttcatggtatacctttttcacctttttattttaaacttattagtgtcttcaatttagaatatatcctttgtatacagcatataattattttaaaaaaatttatcctgtcaacctacacattttgattcatgtgtttattttcatttaatgcaattattaataaggtagaacatatattggccatttatttaataatatttgttttctacatatcatatgtcatttttgtttctccattcttggatttctcactccttttttgttagatattttctgctgtatcttttatatttgctattgttcctttttactattttttgtgttatttatttagccattgccttgtaatttacaactagcatcttaatttagaaaaaatttgttcagataaaatactaatttaatttcaatggcatacaaacattattccaacttcatttcatgtttttcacccctttgtactgtaattttcatacaagttatatctttatatgttataacccaatcaacacgcttttataataattgtttttatgcagctatgttctaaaacaagtaggataagaaaggagttacaagcaaatgtgtttatgttttctttcataataactgtgtggatacttttactaggtcattttgtgtcttcatgtggtttcaagtgactatttattgtcatttcatttcagcctgaaggacttcttcctttagtgtttccttagagcggggctaaaagtaacaaatgctctcaggttttgtttatttagaaatgacaacttctccttcctttatgagagaaagtttagctcgatatagaattctttgttgacaagctttttcttttaatactttgaagacgtcaacctaaatctcttctgacctctgtggtttcttatgaaaagtcagctgttattataattgagggttccttgtatgtgatgttatgtttttagtgctgttttcattaatttctctttgtctaagttttgtcaacttgactatgatctatctatgtgtggatctttttgagcagaatttttttgagtagaaacttggaattttttgaacttcttaagtatatatattatgttttatcaaatcgagaaggttggagtcattattttttaaaacttgtttctacatatttctccttttcttctctatagtctttatggttttccttctttttaaatattggatatgtctcactctatacattatttatatgtgtctcttaaaatagtaactttaaattataattttaataaaacatggtctaataatctaaatattactctcagggttttccagtgacattttttaaaacaagataatgaaaacatatattgtaaaatataaatatttacactatctgatatgaagttcattagatacatgtggctacttaatttttaattaattaaaatcatgtaaaatttaaaattccatctttcagtcacactatccacattacaagttttcaatagctaaatgaaaccaacagctactacattgtacatcgtagagataaaacattttcatcatcacagaaatttctgttagatagaactgttgcagatgtatatatcataaaaaattcccccttcataactcagtacccatttttgaatgaagccatgtaaatatttgtatctgtcaaaaatcttctacagaaatatgtttgtatatatcttcatggatctatacataaacaatataatattctataatatatacatttatatgtgtgtgtatgtgtatatgtaagtgtatacgtctacattatatttaatttcaacagtacatatggtctatactttttatccacttaatgtatcttgaagagctttttatatgaacttttttaaaacaaaaaaaattgtgtaatagcaccataaagtgttcttgtatgatgtattaccactggtttaaatatttttctattacattactgctccaaaacaaacataaacaaacagcaaagcaggcatatttcaaatatatatgtaggctaaatatattccagtgtattggtgagtcaaagaaagtttatattgcaatttattagataatatcaaatttcattaatcaaacccaccaatagtgtatgatactctctgttagtccactcttcctgttgttgggtattgttcaaccttttagttattttcaatttggctgataaaagatagaatttaatccttatgttgatttacaatgatttaattatgagagaggttgagaatcatctttttatatgtgcattggccattgttgttttctggtgtttgaattcctgtgcataagtctttcatattgggactttgcaaatgacactcatggcaggaacattttaaaaaaatatttgtacttagtcttaatctaactggaattattcattcattaatatctgtaaagtccactgaaaggatgttctgtgtttcacatatcttaataaacctttatctgttgaaactggcctgaaagaagaaatgaatgaatgtaaaggaagagagaacaatgggaacagttgtgagtaaatgtctataattaactcattcagttataaacacctgtttaataaaattggaggaatcatctaccctataagagttggaaatattacccttaaattttccttcagtttttaaaatgaaataaaatgaataatgaaaaaataaacacacacactgaacaccttcttccagccttaggattaattcagcctctatttggacattgaaaaacatgcataaaactgatttatcttagcattctacacacttcacaaaaaaattgaagctattggtgaacatttctgagaaagtggacaatacaagaaaaggcttttggatttgggccataaaaatgcaagtttagtgcatgacaactcaactagtgaatgtctgcctcagctcctaagcacagttgaggagatcagcagtgtttgcagatgttcttgggagacagtaaaatagaacccggttcttacttcagagcttgagattttgctcaagacattgaatctggaggcagctcttgattgtttcttattgtcattgtcactaaattggacttgattttataggccttctttctttccccaactaagcagaaagtgccaccagggatgtaaatctaaaattattcttttcctttatttttgttatttgctttggcatggaagggtcatttatgatatctctgcttatcaaaaggatactgacaaataaacaggaaacagcaaatcaatctattattaggagtcccgaacaggaggtataatgttacatcggttaatatattcaagaaatattgatattctaagctgaaaacctgagccttgttattctttgttttttttttttttttccaagtgaattgcacattcagaatcttcttaatggtcagatccttatattttttgttgcttgcatcctgtatctgttataatttcatgttaaaattagaggatggagatattttagcataccaatatgctaagttgtaaattatgaagacataatgaaaactcttagttaacttagagaatgttaatgtaattaatatgtaaaaactcttccaaatcaattgaaaatgaacaaaaaatataaatggactttttatcaaaaaatattgttgataaatttaaaagctgcttaacataattcacaaacaggaatatttatcaacaagaagatagtatttttcacatatcctattggcaaagattaaccctgatgttaccatgtattggaaagactgtggaataatagagcctcttactccttgatagcaggaatgtcatttgtgtttttactttgggtaaaattttgtcattattgtgtgaagtataactttcacatgccctgtaatctaaaaattccttcctaggtatataccataaggaagcaattgcacgtgtatttcaggaaacaggaacagggaggtttattcagtcatagttgcaaacaaccactggtctcctcaactgtgcttaggagctattaatggatatttctgataaaatgacctgtagaatgcatggctttcaaccttggagaattaaagtgcaagtttagtaaatgaaaacccaacttttaaattaattcactatgtaaattatttatatccttgggtttctggttaatgtctaactcagtttgctttgatacatatatatatgtttgcctatatgatgtataatttaatcttagttggtcttgaacttttgaaagaggcatcaggtagtccatgatcatcttatacttccctttatcactcagcattttgttactgattcatgcatatttgcatttaacctgtagtccagttattttataactacaagatattctatttatgtcattctcttggttatatgatatgccattctttacatatattaccatatatttattgtttatcttacatttaaatttaattgggaattaaatttgtaattgctaaatctatcacgattgacaatacgtgaagagacaaaagctgcaattaatccaattcaagagagaaaatgataaggatagagtagatatctgtcttatctattaattcatatttgtcttatctgctaaatagatatctgtcttatctactagttcattttgtattgctgtaaaggaatatctgaggctgggtaatttacgtaaaagatgtttatttggctagtgattctgtagactgtgcgaaaagcatggccctggcatctgcttctggtgagggcttcaagttgctttattcatagtggaaggtaaagggcagcctgcatgtgcagagataacatggtgagaaaggaagcaagaaaaagagagaggacgtgccaggctctttttaacaaccagctctcatgagaactaatagagtaagaactcagtatgataaaaatggcaccaagccattcatgaggaagcctgtcccatgacctaaacacctatcattagagccccacctccaacactggggatcaaatttcgatatgaggtttgaaggagtcaaacatcgaaactgtagcaatatcaaatatggtatcactgaggaatatatatgaatatatcaaatctggcacaattaaatatcttttttatttgttaacctatgttttctcctattttttggaattattaattataatgctaaattaatgatgttatataaacctaaaatgagcctttgaaccatcagctgtcaagaagatttagtctttgaagcactactatttttctgtttctatttcataaaaagaaaattcagccatggtaaaaaaagtttttttacttaatattggacattatagtttcccttctttttgtaaatatgggaattgcaaagcttttggtaaccattatttttcttacactagaaataaaatcatattactaattgaaatacttaaaatatgcgtgttttaaaataataattatattatttttgtttatgaaattatactctgtaaaatgtgcctgatgggctatcagaacaagaatgaaattaagtaactttctactgggcagctccggtctactcatcttgtaagtattatgttacacacattgtataaggccatggtgaggaaaactcataccgaaattctaatgtcaaattttttaggacttccatagcttttatatgctgtattctttaatgcagctgtgcttgaaggtcacagcaccatttaaaaatatatatatacttgatataggatgattataaagcactaagacaatttgaagaatcattagaccagcacaaactgaacttcacataaataatttgcataaatatggaagttacaatatttcttttcttctttcatcagcccataacttttccaatttattaaagtgttgggtagagaaatattggcatgactctcaaattcaccttttctgccctatttttttaagttattaatagatttcagtgatcattaatttccactttctgcgaaaaataaaaattgctttttaaatgttttagtgtatggcctatgatgtaaatgaatagaatattattttggctgtttacatttattgagcaataaaaatatatgtgtgtcagtctatatggattagtaggtattgattcaatactcataaaaattacgtagttgtatcatggcattttctgcattgggttgttttattaaatactccaatatcaaaatgcatggtaacaagaaaatatatatatagagagagcatctattatgtttacaaaatatagatattgcagatgtcaggaaagagatataatttaagcatgatcataattaattagtcagctaagaaaagagaacatgaaaaaatacacagtaaaaaaaattgattttaaaattttctgcatatatagccagctatagctacagagaacaatcaagcctttgtttacagctaaattataaaagctatttgcttcttttctgttcttaaatccagacagtgaaagagagtgtgtcttttgcatcattctagggactgctgcctcctttcccagcttctcttgatttcccttttcttcttttcaactagatcgtaatctttttccctcttctcctccacttatggtccactggctttctaaaatccttcctcatgctcaaaccagggaatttggtcatttatggactgcactatgaaagaagcattttcataatatatacttaattacatgtttcaaaattaacatctttccaaaatgatagatggcttttctaaatatttttgtcaggtatcaaaaaactaataatgagattgagtagtgagggaagttataccctaaataaattaaacataaaggatggccgggcgtcatggctcacgcctgcaatcccagcactttgggaggccaaggcaggtggatcatgaggtcaggagtttgagaccagtctggccaacatagtgaaaccccgtctctactaaaaatacaaaaaattagccgggcgtggtggcgggcacctgtagtcccagctactcgggaggctgaggcaggagaactgcatgaacctgggaggcacaggttgcagtgagccaagatagcgccattgcactccagcccgggtgacagtgcgagactccatcaaaaaacaaaacaaaacaaaacataaaggatatgtgtgtgaatatttagggagtttgatgggctggaggttgagggagcagggaaaatatcataggatccaagaagacttacatttttgtctccatcattcactatctgttaaaaatgtacccatctatactttcagaattattcagccaaagctcctggagcatgatttttttttttaattttgtaaatagagatgtctttagatatttttattaccagcttattccaaggtctagaacaatacacatccctactacacagttcctaaggttctgccgtttctcaatgttaaggcaaccaagtcctttataccaacttgtattaattgtaactgcatctctcattctgccttcactcagtcttttctcagtctcaagtcatgcaaatgaatattttatgttttctgacacttctgacatttaagtttgtgtttaatgatttcttgctatgatctttaatatctgacatcttggaataccatcattatctcattttctacctctagttataatgtttctgacaaaagtgaatcattgtaatggggcctcttaatagggacattaccgtggcaataaaagatgtaaattgcagttccaaacaacctagaagtgcaatcacgaaacagtgatcaatggttagatgaactgcacgtgtaattaaatacatgtgaggtcagatgaatcacttgagctaagaaggacagggaaggcttaaaggagaagaattagaatgatccttcagagaaacacaatttgagtaaggaaaagggaaaggtgaaggtggtatagcaagtagagaaagttgaacaaaggtacaagaaaaagaaaacatgcacatttaaagaatacaagcaatggtacaccatgttcataactgcatgattactggcccacccggtagagcatgtcatttggggaacttgttccttttctttagagggcatggatttacgtggaacataaactttcatctattactctgtataaatgataaaagatgaggctttctggcatctctcttaaactccaggctttttatccacaaatcctgcacatttcctattggctatccttcaggagcgataacaataatgtatataaaattcgaatgtctaaaactttcctcaaaatatgcctgtttttctttattttctccagtgagaatgttacaaaagcaacattcacccaatgataaaaacttgaaaacctggagttattctgtatactttcttctttctccatcttcaaatctaatccttatttttttttttttgtattttattcacaatctcccctgtacatgtccctttcactctttgcctctgcttcttccttaactttgtaacattgctttcttggattgtcatgagcctcttaccatctctcatgaactcgagatgtcatcaaatctaactagtttttcacccagttgccaaggtaatagttctaaattcaaacctgattttgcttctttcttggctttcagttttaccacttatgaaaacagtaataagcactggcatattcatgttgacaataatgcatacttcatacataatagcagtaatctatggaatcatccctcatcttcccaagaattgtttttaagctacttgtgcattttttgaagtttattctcatattgtaggttgtaattcaaaactggcaagcttgtaggctccagacagaatctggcccccaagtatatttaggattgaatcataattttaaaattatgaaattataagttaaattttgctttctaacttttttgaaaaaaatggaaaactagcaatactgtgtatttttctataggacattgtatctggagctgaggagctactgtgctcttttaaataggcggtctgattactccgcctctctgtgattcttacacagacagcttcagtcttaccctgcttacccagtggtttcaagcaaccatgttttggacccttgctctaccagtgactaacgaggttcatgacatgcatcttatcctgaacaatatggaaagggaaacatcctagtgggtttggtttcccaactttgtagcaccttcagtgtctgcctgggggcttgttgtacagtgaatgttcaacacataagattcgcttgaatggaatgatacgtacaaaacaggcaccaccaaatgttcccaagctgccggaaaacatacatttgtttctctacttgatcacataccttgtctttcttgcttaattcatctagttaatcacctgcatatttgctttactctgtttatcatatcttgcttgccttcaacagaatgtacatagatggcaggattcatgcatttttatgccctttgtactattttggatgtcgaaaactggacaggcaggcatcattgctgagtaatggcaatgaacacatgtggaaattacttttgcatcctttcatttcaatagtaattaagttgttaaatatgaaggtactgtaatagcattattggcaataatcaacttccccaaaccacaatttgaagtcatattaagttgaaattaaaccagaactatttaatgtctacaattagaatcagtgttgaccaagatgtctcctgtggctgaaagaaagaataccccaaatgcaataaataataacattaaaggcatacactaagagggattgacctaagatttccaacatcttctggcgtgttgactaagctgccgagatacgtttcttattcgtgtatcatcagtaagtttctctgcagcatcagtgacctgcccacgactctttaatttcagagaagattcagcagcttgggccccggaaaagatatttggaaaatttcccagtttgtgtgctgcataagcttgaggcagtagagggataattaataaagtgccagactgggtaattgtaggaactgtaaaagatactaagacgttgttaccggaggcacagacgcacctgtgaaagcgtgaagttaatttgtgtgaggaacatcacatgagggtggatgaggatgagggaggtgagatttccttcaaattaattcagactttagtcagagaagctctcaaaaaaaaaaaaaaaaaaaaaaaaaaccctcctgctagtgagataatgtaaggcttatgaaaagaggccctcctggattgtcttgttacgtatgcttctctctgaccttgagaaaggtgtaacaactgcaacgttggaattttctaatccctgtaggacaagaatgatgacattgccctatcagtctttacataacagcgtaccatttcatactgtccccttgaacatttccttaaaaacaatacacctcctgatactataatgttggatactttgtgtatccagtgtcaccccaaattccccataggttaatttctatcaaatttcaatatacaataaagtaatgagagagagaattaggtcgtatcatagtattgccctgaagactgtttaaaatcattgataactgcaaagttcctaacaacttgcagaccacatggtagatgactgatcagtggtagctgctaatgttgttattttcatggttatttaaatggatcttttaaaaactaaaaaacaaaattcttgacatgaattgttgccagtgaatgttgttatcttcttctaaaatgccttatatgtagattgtacaagataggtgtaaacccccataccttagcattgccatatggtgatgtctcgctgaccattccattctcttgcatatctggctcaggaattaataacctatgtcattccaaaaatgattctctgataccaattgagtgctctacaattcaattcaatacggagactaattaccaggaattagcgtacacccacagttaaggagctcaattcccctggtctgtcctcacctcagatgccagctgccagtccctggtcccaatggtactgaattatgtccaacctggctacaaatgtgagggttctcattaccccttttcaggctggagaatttcttagaatgactcaaagagctcggacaagagctattcttatgagtagcagtttattgtagagggtacaaatgaacagctagatgaagagatatatggggtgatgtctgaaggggtccccagcacaggaggctctttctctttggactggggtacatcaccctcccaatgcatccatatgtttaccaaccagatggttccctcaacccttatcattcagagtttctaagcaaggtttcatcacttaggcatgatttattcaatcactggccagttgctgaactctgatctccagctcttctctcctaccagatcttagagtggggctgaaatttctaaacttgtaatcgcatgattgatgtgatctgatgaccagcttaatcctgaaactataagctaacgcctcccctcacaaagagtcctctgatgttgcagtcgcattagcatgaaatcgaataaagtgcaaagaagtttgctatgaataacaaaagacatttctatcatttaggaaatttcaagggtttttggagctctgtgccaagaaccagagaaaagaccaaatatatattttattataccacccaaacttgccaaatattgattagtctgaatttcttatcctatccattgtgttttggggtccctatgtaaaacaaacaaacaaacaaacaaaaacaaaacaaagaaactctgactttacacttttctggactttatagagagcagtcttatggaaactataaggtgtgcacaattgtttatgcacgtatttctctgcaaataccatgcaaagtatctattatgcttaaaattttatactatttattttgtgtttttttgtttctattttggagttttttcacacatcaactcaatgtgcttgccctctctttagacgtgaattagacaaatatctctatttcaagtgaaatcttttttctaccttgaatgtatttgtttcattgtgtagtttaaattccttctgtcctcaaatttgttcaattattagattataggctcaaaattagtcaagtacagtgtagtagtttttgtttgacatcaaatgcaatgttctgtatttgtgttttaatctgtttcaccctggggatttcctttaaagagagtctgtctttaatgttagtatctttttaaatataaacattcaaccagtaagaatacaaaaacacagagacagaaaattatgacaaacagaatgtcaatacttcttttccttttgattaatctagcatgcaaattataaaagcattttggttactcaggaatttcaataggcctttgaactttttaaataataaaaatattaacatattctttaagagataacatatagaaagatatattagcaaacctgttcttactgaaatgtctaatatgtcctctttaagctttttatattcatctgaataatcatacatacatacatgcaaatatgtatacaatataaaagaaatgagaatgccattttatagtgctatgaaaattgatttttttttacatttatacatccaaattcatgttaagaagtttttaaatataactggtttttttttctttttctaggtaaccttcaaagcatcaagacattcagtttcaccagatttaaaatatgtccttctggcatatgatgtcaaacaggtaaaggagtgatcttctttgagaatacttttctttgtgatgcattggggtgacaatgcataattttactcagctataactcacctaagcaaaatctggcatgtctagtaactaccggaggacagtaatgactactttgcacaaaagatgtttgaagataatgtccaaacatcttccatatctgcacagcaaataattgggacagtttgcccagtgcctgtgctgatccaagtccatctcttggcagaggagaatgtggcagagtttagcaaatccaacaaatgcgggcttgtgaaagtttcaagataagccttaccatatacttgagtgtttcatgtgtgtacagattagagactttcctagtggctgtgcctagagcttcagatgtgtatattgggaaggcaactgctgaaaacattgattatggtcaagggattctttactggtatttgattgtcagcttggggttgtagaaaattttgcaaatggggcaagccaagcaattaattctgaacaaataaaatgttctaattgaaattagtgtttccttattccatgtgagccctaaagcacaattagagcaatatgtatggttgttgagtgttttgtacttaggtatcatttgcacgattaaaaagcaaagtaaatgttggaaagccaattcagcagattagtatctgtaaagaataaatgattggaaatcattcaaggacgtttatgagctttaagacgaacaataaaaatttatgaacttaaggcaggaagcctcatataatgctttgaaagccttttgaacacatggaatttcacagttcgaaagaactgctatttgatggctttagtcttttggaatatacatgtgctatatttttaaggttatattttttgacttaagtaatttatgctgtaaaagacagagggattttagtcaaaggcctcttttcctagtatagatgttggcctgttgtcttatcttttgctttgagttatctttattcattgggattttgtaagtcatatgttatagtaagaaaaatacttgacatttatagactaaaatattatgctaaaaagtttctaacataacattatctgaaaaatctaagcttgaaaagtctgctatattaaactgatcatgaacttttaaaaaatcaggtttcaggagctattgtaatgaagactggaactggcagtaggacaaacacatagatcaatgaaagagaagagagaacccagaaatagaccctcacaactatgcctaatagattgttggcaaaggtgcacaagcaatttaatggaggacagtcttttcaacaactagtgccagaacaatcagatatccataggcaaaaaataaaaacaaaaagcccacaaaaaacaaaaacatcatattggcttaagccacacaccttatacaaactcagaatggatcatgcttttaaatgtaaagtataaatctataaaacttttagaaaaaaatgtttgggatttaaggctagggaaaaatttcttaaactgtataccaaaagcacagtccaaaggaggataaactattgttccatgatagaccctgttttcaggctaaaaatacaagttacagtctagaagaaaatatttgaaattcccatgtgtgacaaaggatcaacattcatatataaagaattcttaaaaatgaacggttaaaaacaacaactataacaaaaacacaactatacaatcagaaagtgggcccagacatgaagagacatttcactgaagatttacagatggcaataagtacatgaaaatattttaacattactagccaataggtaaatgcaaattgaaactacaatagaatatcactacgaatctatcagaatggttaattttttttaagtgaccacacccaatgatggcaagcatgcagagaaactggatcattcatacattgcagttggaatgtataatggtacagctactttggaagatattttgatagttttttaaaaaactaagcatatatttgggttggttccaagtctttgctattgtgagttatgccacaataaacatatgtgtgcatgtgtctttatagcagcattatttgtattcctttgggtatatacccagtaatgggatggctgggtcaaatgatatttctagttctggatccctgaggaattgccacactgtcttccacaatggttgaactagtttacagtccaacaatgatagactggattaagaaaatgttgtggggtgggggagtggggagggatagcattaggagatatacctaatgcaaatgacgagttaatgggtacagcacaccaacatggcacatatatacatatgtaacaaacctgcacattgtgcacatgtaccctagaacttaaagtataataaaaataaataaataaataaataaataaaaaccaaaaaaaagaaatctaattataccacataaataaaccaacatttatttaaacattaaaaaaaaaactaagcatatactaccatccgacccagcaattaaatttcactggacaattccttcaagtcatttatcccggatacataaaagtattcacacaaaaacctgtatgcaaatatttgcagcagccttatttataatagccaaaaactgagacagcccagatgttcttcaaaggatgaatggctagataaactgtggtccattcatcccatgtaataaatattcagcaatacaaaggaacaagctttcaatgtagacagaaacatggataaatcttcggaattatgccaagtgaaaaaaaaacagtcccaaatatgattgtttgtatgatttcatctatataacattctcaaaatggcaaaattaaagaaatgaagaagagattagtagtttccaggagaaaaggagggaaatgagagcagctttttttgttttatgggacaacaagagggatctttgtggagatagaaatgctctgtatcttaattatataaatgtcaatgtccttgttgttttcttgacctggttgtttacttgaccaggatttcttatagttttataagatagtatcggtggggaaaactgggtgaagaacacctgtgatctctcagtattatttattataatggcatgtaaaaataattatgtcaaaataaaagattttaacttgaaaaagctgtaattttttaaaaagtcctaaaataaggcaaattttttttttttccggtgggagggaggccgagagtttcactcttgttgcccaggctgtagtacaatgcacgatctctgctcactgcaacctccacctcccaggttcaagtgattctcttgcctcagcctcctgagtagctgggattacaggcatgcaccaccacgcccagctagttttgtgtttttagtagagataaagtttcaccatgttggtcaggctggatttgaactcctgacctcaggggatccacccgcttcagccttgcaagtgtgagccaacatgcctggtggcaaaagtttttttttttttttttaattcagtttcaatttattttattaagtgtatggattatgcaagatcattgaaatcttttaccccgaacaaggtactggaaagaggtaaaaagatttaagtatgcatttccacatttatagttttatgcaaatctgatacagtttttaaagattagtgaatgaaaatagttaaaagtagtaaaaaatgatcaattattaaataaactagtgaaattagtttgagaacttttgtattcttgtccaagtcagttgatttctatctagaagaacaatttttactatttgttttcagggaagctggttaactgtctatgaaaagtaaaactgttttaggttatgccagatcatccctgatagtgtcacaataaccattctctaaacacagaaactgaaactgctttttcatcttatttttaaatagtaactttgtgtaatttaggtttatgtttttaaaatgtggaataaggaacataaaactaggttaactttgagtatttggacaaaatagggcacaaacttttaaaaatataattaacaatataaacataattatggaccagtcttcatattcttatggtcttttttttcttatcaaggaacaataaagatactttatgacaaaataactggaggtgaaagaatgctagcatttaaataaattttagaaactttatttcaccattttatatcatttcatttatttattcattttatttattaattatgtcccaggtgcaattgctgggctgtatattatagggtgtatttgtgggtatgctcacataaattgaattacctccttcaagaaatttataaccaggaagaggtgatatgacacaaacatttatatccacagcatacaacatcatgttatgtatcatatatatggtagtttcaaagaataaggaaaacttttactcagggtaatcatgttagagaagaatcatatgctgggctttgaagagcagacagctaaaaatgaatagaaaaacaggagtttgagaccagcctggccaacatggtgaaatgccatctccacaaaaaatacaaaaaatttagttgggtgtggtggcacacacctgcagtcccagctactttggaggctgaggaggagaatcacttgaacccaggaggcagagattttagtgagctgagattgactactgcactccagcctgagtgacagggcaagactctgtctcaaaaaaaaaaattaaataaagaaatagataaataaataaataaggcaagcagtcattctcactcttggctatggcattagaatcatctggagagttttacaaattgtttatgctgaggccctctcctgcagaaactctgatttaattggcctgaggtatagccccagctttggagttttacaaactccccaggagataatgtgcagctagggttgaagaccattgaatttaagtgaactgatctcttccacccattgaagactttccagatttcagaaaagggaaacattagaaataaaaataaaaacagctaattatttaaactgcatgtattttgtgccaaagtctttacttgtacacgcttaatccttatatcttttattcttaacacacaacagtagttggtgttattcttcctttattggtgaaaatacagagactaacttacctaatatgattcaagattgagtttttttttttttttcctgaaacagtgggtctcaatgtacatgctcagcatagcagcatcagcatagcctgggaagttattaaaaatccaaattctgttgtcccattgagacagaaactctaggagtgggcccagcaatctgtggtttgacaagcgtaagtgattctgatgcattcaagactgagaaccagtgtttagggacctgattccttaaactgcaagagcgctacctaagaagagagctacgcagccagaatctcaccatatgcaggacaaagattaatagaaaatatcatttaagagcaatgatctaccctgtttttctttagtttttcacaattatttcttcctggatttaacgtccaactgttcatttctgaccttggatgttgctctagtaacaaatttacccttcaaggttaatgtttgatctgttttcattataggtggcatagtggggtgtgcatggaagttggaagaaaatatgtgtttaaattcaaattatccatattaaaatttgtattgaaatataacatacctataggagcttgcatatactatgaagatagcttgaacttctataaaccaaacacctgtatggtgccatcacccagataaagcagcaaaacattgctgttctccattctgttactacgagccacaagggagaacactgtctacatttgtaaagattaattctgcctgtttttgcactttaggtaaattcacacactatgtactgttttgtgtatctcttattttactcaataattagttcataaaatatatccgtagttttcaagtattgtataacagattgtacattcccactatgatataccattccattgcacatatcacaattgatccactctactgttgattagattgtaatacagatgtacatgagcaatgcattattgtatagattatttgtctgatcactctctatttcccatccattactctgcttcttctttgacacctatttcaaaaaaatattatttaagagggcacaaacattttttgggtgcttagatagtgcatctgccgtggaagtgtgtttatcaatgtaaacctcccaaagtcccgcttcttggctgtttatatcatattttacagaggagacagacttagagatattaactaacttcctcaagggccccagttcacagttgcagagctgggagtgaattttttttcttagctccaaagtccctagcttttcgattactttgtcattttcagaaagttcttatttatctttacagattaactgtgtattttcctatttatttgaaatcatatcaactaattcctaattaattaattggaaggcaagtgaaacatactacaatatgtatttaataaacatattacaatatcaaacaatatatgattttcaatactcagtacttaatatacttctccagacatagtggttagacattttatttttgtatttgcatctttacaactgtttctcaaaatagtcaatgaaataatcattctggaatgccttttaatgccataaaattaaaaccatacttttaaagaagatgaaagcattccaaagtatggcaaatcatgatatgttaaaaccttgatgatcagaatatttgtggttaatatttgtcatctagtattttgatagtcaacatatcagactaaattattttttcagcattctgagtcatgtatataaatagttttaatttaaccaataaatctatgtaattttatatattatccatatatatttggaattattggtccattggaattatttaacaattgtatttttaagccatccttaaaaagtcaagagtcctttaccgcatttttttaaggacaaacatgaagtaaggagaaatcaatttttttaaaatttttaaacaaatttatagttttatagttttcttgtttggatttaaaatacaccatgtcaagtagactagttaactattttacactgtcaaccactttcttaatacatcttatgtttgttatcagaaactttaattaaatttactcttgtttcagcagaattagagctgtcctctatacataatgggacataaatctgcataagaattagctttttccgaatgcaagagtaacagttgaatgaatcctttaaatcgtgtctactagagggaacaaatcaaccgtagctgggctacatctgctatgttagtagtatctgtcctctaaattcgatgctctgcaaaagatcagcattgttattttctacagttagatgcattcatttcagtttaggtctctactattttatagctctgggtacagaattatttttctggtaagtatctattttaactaagaagtaatcctgtaaaatgcatcctgcatgcactactgctttaagaagtaactcttctctagtgaattatctaattaaagtctggaccttaatacttcagtgctttacaattacagatacatatttaaaaattctgggggagtacataatctggttatagaattatctaggctgttaaaattcatacattcggggttcactaatatttcaaaaaatacaaactcaaagaaagcacagtctgggaaagttactgtgttcaaacatgtgggactctgagttcatcctgaaatcctcctgccttctagtgcccatagaatactcacctttcctcgtttgtagttgctgctgctgaactgccttcctatgtaaccttctccttactacacagagatattaaggcattaaaaataagttagtatcaattttggaatatttcttttgggttaaggcaaaaattgaaaagtccctaggaggtggacaaaaaggaaggaaagaagtaaacacaagaaatatttttggaagccagtatttacaacattttttggtgaaagttactaatgtatttatcaatttatcactaattaaacaacacacttttatttatttttttattttttatttttttttattattatacttcaagttttagggtacatgtgcacaatgtgcaggttagttacatacgtatacatgtgccatgctggtgtgctgcacccactaactcgtcatctagcattaggtatatctcccaatgctatccctccccactcccggcaccccacaacagtccctagagtgtgatgttccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattttgaataatgccgcaataaacatacgtgtgcatgtgtctttatagcagcatgattcatagtcctttgggtatatacccagtaatgggatggctggatcaaatggtatttctagttctagatccctgaggaatcgccacactgagttccacaatggttgaactagtttacagtcccaccaacagtgtaaaagtgttcctatttctccacatcctctccagcacctgttgtttcctgacttttttaatgattgccattctaactagtgtgagatggtatctcattgtggttttgatttgcatttctctgatggccagtgatggtgagcgttttttcatgtgttttttgactgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttactttaattagatcccatttgtcaattttgccttttgttgccattgcttttggtgttttagacatgaagtcctcgcccatgcctatgtcctgaatggtattgcctaggttttcttctagggtttttatggttttaggtctaacgtttaagtctttaatccatcttgaattgatttttttataaggtgtaaggaagggatccagtttcagctttctacatatggctagccagttttcccagcaccatttattaaatagggaatcctttccccattgcttgtttttctcagatttctcaaagatcagatagttgcagatatgtggcgttatttctgagggctctgttctgttccattgatctatatctctgttttggtaccactaccatgctgttttggttactgtagccttgtagtatagtttgaagtcaggtagtgtgatgcctccagctttgttcttttggcttaggattgacttggtgatgcgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagcgatttgtagttctccttgaagaggtccttcacctcccttgtaagttggattcctaggtattttattctctttgaagcaattgtgaatgggagttcactcatgatttggttctctgtttgtctgttgttggtgtataagaatgcttgtgatttttgcacattgattttgtatcctgagactttgctgaagttgcttatcagcttaaggagattttgggctgagacaatggggttttctagatatacaacaacatacttttaaatagcatctttttattttgaaataatataactgtattatagagaatctgaaaatacacacacaaaaaaagaagatagaaataatgcctctatccacctccgttttttagagaaaaccactgttaatgtactggtttatctcatctaattcttatttattgttattagtatgtaatattttttccacttatagacaaaattataaaaatagtataacacagtttactatcatgaacattccactatgaacattgttccttgtcttaaatatttctcaaaaacattattttaatggctttaccatcttttcatgtggtgatatcataatttattcaactcaatatctttaatatttatagatagttgacagattagcactctcactattacaaaaatctgtcctgcaacgaacactaataaatatctgtctttgtttattctcagttaaattaatgagactgaaattatgggattatatattttttacattaattagtgttcttgatgcatattgctaaaatgcccactagaaagcaaagtaaatgtatgcttccccagtaaagagaaataatttaaggttccttttggtttatgatgctattttataggacacgaatgctttttctaaggtaaatgaacaaacataaacaacaaaattatttatggataggagaatctgtgatatgttagcaatttctgattccttcttacactgaaagctctgtgattcatattcactctctaagtgcaaatatctaagctcaagtcattgagaaagtaaacctattttaaaaaaaataaacaccttcaatatcaaataattgccttcattactctggtaaaattacactaggattaatagatgagtagaattagcaagcgatggagtaaaagtaagtttctcctcataggagttatttagtgagacttattttaaaactgttactacacaagacagtccttaattgtaaaacataatggagtcatcatttgtatctattcacaggtagtttatttctatagaaataatatcatgttctcattttaaactgcaagatgcaggttccaaccttcttctttagctttgcattcatttacaacatacaggtaaatttgaaacatgtttttagaattggtacctatatatacttgtattaagattatggactcttctttagttcagtgggttcctgcatgtgcctgttatttatttttactatcatgagataagtatctaagacaataaagcaacctatttccttatggtgtgttgactggcaaagaatccccttgcacatggggaggccacaaagtagaaataggcttagcatggagaaaaagtaaagtgagtccctatatatttggcaaatattaggttgaatgtgagttaagcagttttctctattataaggctttagagagattttaataagttagtgtattataatttatcaaatggaagaaaacatagttattgcaccctgactttacttgagacacatcactgtttttttttttttttttctcatggatctgtgtatggtctagaacaaaaaaacatactttgggcagtagtatattaggaaaatactatgatactaagtaaaaagatcttattctggtcacctaataatgacgcacatctgccgaacttcatgtcataaagcagtaatttattgtgatcatagattctgcagatcagggtttctagaagggcttggctgtacatttcccactcgaaggcttaggtgattgatgccagatgtgggggctgcagtcatctgaaggcctggctgagctgggagctatactttcaaagtggctcattcacatggctggcaagttgataccagttgttgactgagaacctcagtttttccatgtgtagctgtccacagggctacttccatgtcgtcatgagagggcttaaggcttcccccagtctaggtaatccaagggagccaggcagagtctgcaacactgtagccttgaaacccataaaccatcactagcactctagtgtgtgtcacacaggcacagctgtgattacaggtgggaaggaagcaatgaggccatgaaattcaagagatgagaatgactgatggctctctcccttgacacagatcctgaaacaaaggaagtaaattgcatgaagacttggaaaatgcctcaggaaatcacgatagagttctgaatactagttaggtgtagtgaggttaggtggctttgaagctggctgaatagccatatccagagaactgtgattaattgatattacatgtgagagcctccatggatcgatcagaaacctatattattatgtattattaatattttcatgtctgtttcttgttctatacactttaatgagtttaaaataaatagataaaagtatacttatcatagttttgaatgagcaaggtagaatagagggttgatttacagataatctatataatcaagattacagataacctaggggtggcaatgctgactggagttcaaatgattaaacttaacagtgtttagagtgaatttaagcatgcattttataaaaatctggctcccaaaatgtagcgtgaaggatagtaatggacacactaacttaagtaacgttattggccacagctcagtataaattcaggctgtcacattaactttaaaaacactgataaatttttaggttggttaataaaattaaactacctagaaccgtgtgccaatactgcagtcaccagccacatgtgtctattgaggacttgaaatgtgagtagtccaaattgaggtaaaaattgtacttcccagattttgaagacttaataaaaaacagaaaaacataatattaattatgtatcatattcatgatatgtttaaataatatttgggatatactgggttaaataaaatatattagtaattgatttaaccagttactctttattttctatgaacatagctactgaaaataagcttacatatgctgggtttgggttacatttctgttgctcagtgctgctcggtggatacaggaggtggatatatcagtgttctaagggcttattggaaaacacctgggatactctagccaattagaggctgtataggagacagtcataattctcaaagatttagcaattgtgatgaaggaattatgtaattgtggaaaaggaaaactctggaaaatatgggaagaataatagatatattcagtattggagggctatcacagagaaaagaagttagatatatttctaagcataaaactagggcccttgatatgaaatggtgccaggaaggcagattttggctccacataatgaagccctctcttaacacttgttttttcactaatagaaggcctagtgttgaagtcagtgagcctttttctctagaaatattcaaaagatgggtagataattgtccatcacaggcattgtgcaaggaaatctaccatgggtgagttatgttgaaatagttaaatttcactgttttccattaatccaagaaggataacagttttacttctgaaatacatcataccataaacacaggaaaaaagagatgtgactttccaactaatatgtcaagtttgaaatgttgcagcttatatggaccttgatttttcttgctacaaatttcaatcaaagcagtagactttgttccatgtaatcgtatcttttttgaaaagtatcaaatatggaataacttttcagagaaccgtaacagtaataattcttagtagaaacagaaaacttcaagttaaaaaaaaaaaccacaaccagatatacacacagagaagaaattcagaagtaatatttgctaatattttctaattataccaagacagcaatgttatgattcctagttggagtttatactaattaattttcaattgttttcacgctgcctattttaaaaaggaaaacagttaaaggttgtgtgttagtaaattaaccagctcaaagagagtgtatagtgtgggggtctctaaatagaaaggaccttagtgtttctgaggaaagaagaaatgtagaatataattagccatgaggtcaacacagttttaaaagaccttggccagaaaatgaccaaggctttatggtcaaaacatttatactttatttttcacagcaaatttttgttaagatataaaatataatctactgtacttgaaatagactgaagtattgcattatgatgcttaattctacttacttaaacttcatgatgtttaattaaaattcacacacatttttcttcccttttcctcttgggatcatttaaggctaaaactggaacttaatctgtgaggtaaatccaacaccaagtacagtgtatgtgcacattatagtcatttgtttgtttctttaataattgaataagtgggggaaacaaagcttgtctatattgggagaaaatatgcattttctgcatcttcctaattccttttcaagagacttgtttcaaaataagagataccttacaggctgaggaaaagctagtggtatttgtgtgaattttgatcttcataaagaaacattaaataatctaagttattcgtgcataattttgcaccttaaactagttttgcacctataattttgcacttaaacttgtgaatactgtcagacaatggttttcatcatattttctttctggataaaaaaattctgtccataatatttcaaatacaaaaacattagcaattttcaatccaaggatatcactttgttattattacttttctcttcataaagaatagaagagcacttttttgcagttgaatttcatttaatatgtatgcctgtatagtaacacattctgagggagagcattttattaataatttacattttctttgtttgcagattgaatgatgccatgagaacaattaatggcatagatgttcatttactctccctcataatttctaagcaaaagcatttttgtatttattgaagggatgcaaaatacaggcatcttgtaaaagatactgtgaaaggggaaattttctaaataatgaatgttgttaatagtcatgatgtttatgtagaatataaatttaaaacctataattaggttattgtggattatacctgtatttattagttattcacttataaaatgaattgtggtatttgttttcagaaaaatgttccaaattatggggcaacatcccatgccccaaaaaatatcctgtttcctgttattggagagttaggttaatttaaaatttcccactattataaacaatgttgcgatgatcatccttgcccttaaaactgtggctgcatttctgataaatcactgtatcaagtgatattaattttgtagaggttattgaggcatattactgcatttcattccaagaagtttcaaacagcacttcctctagctttgtgtttatgtgtgttggggtgtgtgtatctgtgtgtgtgtgcgagagagagagagagatttttaaaatttaaccttttatgcgttattagttttgtggatgagataattgcatagaaagttcagataatttgctaaagatctgctggataataacagagctgggatcagaatcaaaggctcatgatattagccataacgttaacatgatctttttatgttaaaatactaggttaattaatcataaattcattcaataactatccatggaaagcttactatgtaagctttctcctgcactatatgccatggatatagcacagaacaaaacaaatgataatcccttgcataatagtggggagagataaagataaaagaaaataaataagtaaattacgtagcatgttacatggtggtaagtgctagggagacttttattttacattttatttcacttttacttacttttaagtacagactcacacaaatttgcaaatgagtatagagacctttgtattccttacccatcagcaaaatccccccagtggtgacatcttgcatacaaatagtgcattatcaaaaccagacaattgactagcataacataattcatacaattatagatcttaaacctgtttttgcatatgctcattttctgacatgcctttgtgtgtgattctatgacattttttattatacgtaactaccgctaccatcacaactgagatacagaactgctctgtcaccacaacgaaaatctcttttgcttcccctttatactcacatctctggctacttatctaatttctggcaacccgttttccatttctataattttgtcatgttaggaatgatatataaacagaatcatgaagtatataattttttgaaattggcttattttatattgtccaacataatgcccttaagttccatccacattgttttgtgtgccaagattttgttcctttccattgctgagtagtagacagtgacatgtaaagcaaaaaggaagatgccattaaaaagggtgcagttttcaatgcagtggtgagcaaagaggcattccacaggaaatgacacctaagtgtcgacctaaggaagtgaagaaagattcttgtgcatatttgtgggaagagtgtcctaggtaaagggaatatcctgagtaaaattttggagcagccaggaagcccttttggcctgagcagtgagagagagcacaagcattaagagatgacattaaaaaaaaaaagagagagatgacattgagacccattttaaagccctgtagactctacagtttgtggtaactgcagtaactgtataactatggtgattgtattaggtgactcaaatttcccatgacgttacttctaaactctgaagagattgaaagaattatcccttccctacgtgtgtagcaaaatgaatattttataatagaaaaatagtttaattgcaattttatcttttaaaaagatttccattttaaaaaatggaatataaagaactttatattccatttacgaaatgttgtgtcagtgttgtcaaacctttaagtaactttggcatgagacgggaagcatatattctattacttttcatcatccatgatttttactttgtgaaaacctcagttgggggatgcaaaaggaatagaatttactggaagaacagagatagcacctcgtatgaatcagaggacattgcatcacagttggggtcctcagcccagcagagaatatcacagcaaacactaaatagacctgccagaaaattccggtcttccggtccatttgggcagttatgtgatctaagtcaagtctcagtctttcactctatcaaagaataaaaagggtataagtcattttgacaggtctcaaaagcatcttagtaaatgaacaaagctcaggacatcaaagttgacgatgttaatcaaagactgaattgaactggtgcttgggggactggcagtcctaatctgattttcacaaacatgccaatatcaataaacttgcaggtaaacacacagccaaataaatagaagtgcattcatttttgctaaatactagatatttgatttctttaattctgtactatgtaattggaagcttacattttggtgttttacatgtatttctaacaccgcatataaactctttaaaggcagacacatgctgggtttttttttgtctccctcacatgcctagaatatagaatcagtatgtcttcagtcactagctgtgaaaaaaattcatttatctgacatcgaaaaacacaagtcattgcttttggttatgtgtgaatgtcgctgttgctgtaaataaattcagacacagtcaatgagcgttaacatttgattgttattccttctgcttataacaaagaactatgagatgaaatctaactgccaagaatcagtaggggaaagtagtcattgtgttaatttcaatgctgcggtgtaaatttcattaatattaaatggatttttatttaacaattgtaacttcaaaggggacaaaaaattaattaccttaacaaattgaaaagtcttcccttccgctgtacaggtaaggaaaataattaaagaaaaaaaaaaacaatcctgaagaaacactgactctcacatgcttattttcttcctgaaaatgtgagatagtaaaaactgaggaataaattaaaatttgcttctaatgttataaaattttgtcacaaaaaccataataaaaatgaaaatttcttatgatatttgtagaatattcaataatccttgagaaagtgtcaatatagtcagctttctggaattacaggtgtatgctgttgttatagttttaatttcttgtttttacatataaacctcctgggctaccttcagcatatgtgtccatgattgacagtaaagagttgctatttctgcaagtcttttcatgccgagatcaattttcccatttagtccatattaattcctaagtattcacatcttacaaaattaagtgagagagtgtaatctcaattgaggccatgggaaatatgagcaacctggtcaaggttttaaacctgtcatcatggattattttgtatttgtccctgagttcattctggcccaaaatctaactgcccatcctacaactacttagttaagcctttcctcccatcaagagtataactctggttataggctttaagtctggcttattttaagggtcaaagctaaatcaggccacttgaatttagactggtgtcactcgctgttcttaagggcaacataacatatggcattcaagcatatcctcctgaaaagactgaactttacctacagaggggtataaactgttcctcactgctgctggtggtggtgaattgatttcaaatgtagggttgcttatagttggaggatgtttccttttgctttattttggttcgtattttctgtttgttaaatacagaaaagaggctgtttatcctcagaaagtttttcttgactgctgcctaagttgttttctttcttctgggttaaagaaggttttctgggatagttaccgagaaatgacagtgatttttatgtcagaggggatggtagaatacctcgatttattactgaggcccaaaaaagtcaagtgacaaaaaaatctaggcagcggcagagtctgacctagatgatatgtttccaaatgctcaataaaagactgttgtttaaaatactccatgtcaatggcaaaaggaaaaattttattctctccaaaaaagttggtaaaagacagacatatatcttgatctctttcaaatactaattaccttgcatttctttcacatatctactcattcatttttaaattattaaatatgaggaaatgcggtaggtaatagacataaaaatagttacatgtaattcctgcctttcatttgaagagttcacagtgtagttgggaaaatttgtataaatagaagaattacagaacattagagcaaggagcaaagaaaagctccaaaattccaagaagaaggcatcaaaactgttatgaagattgggtcggagttttccaatatttttttctttttaagtgggaagatgccttcaggcatgtacagaacagagccatgaaaggtcatagtgtgtttgcacaacagtgagagacttggtgtggtaggagagttgggaaataaagtctggaaatcagaagtttaattcatgtatttgctaattattttcaatccctgaagttagctgtgatgaaattaaatcacaaatccccaaatcctcaagggctcataaatcctcaaatcctcactggctcacaaagactatatgggatttttacatcaggaaagagctgcctatttgttggttgagaatgctgtttttatatggcacctccagtcctaatgagtttcacaagatcacaggaagctacagagtctcttgtgcaccctctgacctaggacttgcagtaaaagtagatgtcatggtcccccctttatttaatgttttcatccttgatgctcagggcttttccaacgcattcttgaccttgctagttccgtttctatttgagaatggacaaaaaaggcaagaggaagctctgagcaacgcctagatttaggaatgactgaccctcttagacttaaggtctaaatctgcattcggatttgggaacatctttttggttttccacatctacaagacaatgacactgatgagttccattctctccctttccaattggccactaaaacatctatcaaaggtagaacagccactacctacttgatcagcttccagccagatgaaatgtcttttgttgacactgaaataactgaattatttatcaagctctgttctaacccaaaattacgtatgtatacgtaagtgtatatacatctacatatatatgtactttttccttatgcatattctgcagttgtatttgccagttgtcctcaatctggagaaatcaaaacctatagctaatcaatgggttcctttacaatgggatagaaaatgtattttctttcttttccattcatttaggtttctctgtattatatctaccaatttttctcaacaattttattcctcatttattttcatgctgataatgataactaagaggattttctactctctttggaatgagttagataatcatggtcctgataaaatataggtgttagggtaggataaaaaggaagacattgataattaaacttatcaaagaccagcaatatcacatgcactcagcttctttctttgcagatagtcaagagcttagggagtgttatttgaggaactaaaggtgtaaattctgggaagactcatcaaagttggatgatatggtggacagcatgaaaatgtcaggtaccttgggaaaacagacattttccctgtttcactattgtgagacaggtctttccagctcctcccattcttgatgcagaattgctgctctatcacatataaaaatgcaatttaattcaaatgctaattattgggtacctactaatagaattaacatccgctgagcctgacaagaaatgatatggaatccttagaagctatgagcctggcctttgaaaagtttataactgatatttttttccttgacttatttttagttgtgcgtattcctctttatccctgacatgaaatgtcacctagtatccatttccatcccagtattgccctacagaaaactctgggctctaagcaagacatgaatgataacttaaaattcccagcgaggtcattcttcatctttcactttgctaaataattgtggaacagtattttaaaagctatctggcaataacatataaagtagctttagaatgatgcttttgcagtcacagcactaaaacctttttttatgaaaacttcaagatttgtgcaaaagtcactttgtaaatgagagtatttaagacttccgtgatacgatggcagcttctattaaaacgaaaacaaaatgctttatctcattttgcaattttaaagtttgtttcatagctccatatcagatacacttttcttaaaatggcttataggccaggcacagtggctcacgcctgtaatcccagcactttgggacactaaggcaggtgaactcttgggctcaggtgttcaacacctgcctgggcaacatggtgaaaccccgcctctacaaaagaattagctgggcattgtggtatgttcctgtagtcccagctactggggtggctgaagtgggtggatcacctgagcctggaggtccaggctacaataaactgtgattacgccactgaactccagcctaggcaacagagtgagatcctatctccaaaaaaaaaaaaaaaaagacataaataatttcattaaggcaaatgacagaagagcttgcatattttctatttctttacatgtaagatgagcacttatctaacagtcttaagtagagttggcatctttccttaagttagatcaaaatcgattttgtttgtgtttagatattcaaatgcattttgcttaataacccaattagacttgaaaatagtgctagaataagtatgtgattttaacttttgcacaataaaaccttgattagctagaagaaaactaacaagaaatatcaattaaccagaaggaacaaaattataaggcaagctcaaaagaatctagaatttagaaagccgtatagaaaatgtggaagaaattatgtgctgaaggttataagcaaacatctaatctgattcctctgttttttatggttacataatcactgtttagatatttaaatcttctgggatcatttaagcgagttttctcctatgcattagatccttcttaccaaccagaaaagtggaataaaattatgacagtatcatcaacaaagactgaaagaaaagtttctgatgattattcaagtaactcgagtccagcagaacctctaattttcctggcattatgctaaaaatacatgcatggaggaggtgatagtattaaagacgagtttcccaggcagacagtttaggacacagaagtacagacaaggcctcggcacacacaggagtattctacaaatatcagtatagaaagtcagtgatgcaatgaggagcttgtataataggctttagctatattatcaacagatttcaagacccattattacttcaaacaataaagactcagaaaaagatacagttccttgcctccatgaatttaccatctaatgatggatgaggaaggagttcagtaattagacacataaaacagccgttgataaacatcataatgatgtttgatatgtccatgatataaacacatgtgaaatttgagacagctgtatattcatttgaaaatagcattcgcctccatctcaaatacaaatagtcttgcttgattctgtggaaatgtggcagtggcatcatgtgacaaagtttaaatatctgtgtaattatcctcttctctcaccaaaatgtaatgttctcttgattcttctatttctcttaaaggtactactacctatctaacaaagcttgaagccccggttatctttgtagcaccatcaccatcacttacccaattttgttttgatatcaaggaacccagctaatggttccactgcaaatacttaatcaggcctcttagttccctcctttgctatgattccagaagccatgtctctattactgccaggtacattctatgaaataatggctttgttgtttggatacattgacttgctgaaaatcttaaatggtccagtgccttctgttaaataatgtacaaactagttaccctgatatcaaagtctatacggtaggcctggagctgcctttctgacattattttctatatctgtgctgtgtttcctttctaccccaactgtgtgtgatcagtcttctcccagtccaacaccctttgtcctttcttgtgaggttaactgcactcactcacagatgttccttccttgatctccgtccctttctatccaactttttctatccttcaatgtttagtccaaagatcttatcattcatgcattctttccctattctctcatttcaagatgactgtttctgtcactgcactcttttaccactcctttggtttattataaatattggtctgttcattccatttccacaccaccacactagttagaatctctatctttattcaccgggattgctacaatagactcctatttgatctctatagccaatgtatcttacttcctctctagtccattctctgcatagaaaccagaataacttgtttaaaaacacaaaccagtcactggcttaaaatcaatcattgacaccacatttagaataaggtctcaatcccttaaagctctacaatgatatgcaagctctggcttgtctccctctctagttttgtctttatccaccgtccatgctccaggaacatttgatggaatgcatttttgagtgtattttatgccttcttacccaaccttcacacataccattctcccaactgcaatgccctttttcccacatcacacacattcctgagccaagtcactgtgatgatgtgattctgcttctcagaatatacaaatcaactccatctatgcagctcaggtagaattaattccactcaaatcatttgagtcatacaaaaagggggagagacagcttcctaaagggaagtccaaatgctataagaaaatgaaagaataaatgctagtcaggcaagagtgaaaatccactacggtcagtaatggctcttataaaaatacatagttatagaatctttaatatgcatgtgaagtatcatgaattacatagtgaaatatgcatgaaaaatgaagaaaactcatcattgtacatggcatgcgtatcatccaatggctaatgtagctgagttttttttgtcaagttagaaattttcattctcataccaatccctgtaacattgctattgtcattgcatctctgaaacatgttttcagaatgacagctataatgaaatatctgatgcttacaaaatgtgctcaaaaccatgttcatgggaatatgcatagcacattatttaaacagatgaagtctccagtgcacctcacaacccagaaatatccccttcattttctaactactttttcatgcagaaactgaccctcgttcttagtttttgcatgaaatttacagtagccatctgcttaggctgtgacctattttctttctcaacttttctgttaaagagaatcaactataacgcttatttaaaggaatgtgaataagctaaatatggggttgcagctggttcagactctctattgaaattctcatggcctggtataatttaagatctatttatgtaattgctgtgaagtcggagaaacaatcaaagaaagctgtgtgttacatcattttgccaaaagagatattgtgtttgtctccttgtttaaagaactgaactccgtagtagtaatctggcccatccacagatgtgcttaggtttaccctcacaatgttaatgcaaataatgactaaaacattcaaaatataatttattgtcaatatttaaaaattggggaattttatattcaaaatcatattccttttttttctcttgaaaaattggaagatctggcaatattggcatatggagacattttcccatggtaaccattggttcactctcacagatggggcattctctcttcaggtaaccttagcactcacaatttttaatagtttattcttgcagacttcacttgcttgtagtacctgtcaagcttttgtagacatttcagattgtaataattgcttgtcacaatgggatcctctcaaacaaaagatttggccaaaatgaatagtataaggagtacattgtgcaatataattttaaaattaagaacaaattgctcttgtgggcttggctatggctatgatatgggtagcaagaacttcccaagactgggctgtagttaaggctctgggtgtggcagtgaccatgggtcaagctatggctgtggatacagctgtggctatggattctctctccaatgaccatcaaattctcaaagctgttgatcattttgctgctaatttttgactttcaaacttttcatgcctctccctagtattccatgatgaatttcaagatgctcatgttgatttttcttacatttctctttattccttatggacagtgaaagataacatgacattccagtttgatcttctgcctcttgggcagtttccaatattttggtacaatcgacatttaagcatttgctcatatactgtcaaactatgggaatccaatgtatctatttgtatatatattttatttatcatacttcctaatgaaatgtatttacatttatttttaaaaaaggacaaatcactcaagttacaacctacaacaactagaaatcttttcagctacaagtacaagaaaactcaaacacagttggttaaaaaaagctagttattaatttcaaattatatctattaagtaggcagctaatttcatttgttctgtggctctacaatagcagccactgcgtttctaattgcccttaatctttcactgatgcctgtgaccttgctgtaagttggctaccatagttccaggtgtgccacacctattccaagcaaaagagtagattgaattaaacggcaaagggttgcattagttttgtttgcaccctttttatcaatgaaacaaagtatttccatgaagtactacctaggtgactttaattaaagtaaatccctgtccaagaggaatgagattataatgattcatttaaaacaatcataatttatccccttggaataacacagcatttgtcctctctgagattaagttatctcccagagttttcttagcatagaatctgggaaggaggtgaagacatttgtgtaggcaaaggacaaagtctgtcacacaagcgtctatgctcccatttactttcaagcaattttactctgaattttgtcttgtacttcatgaaggctccttccagaataattattgcctcacacggaattattatcaaaccaatcaatatttctgataaatgaggctgctgagctgttcattctgtaggttttattcatctccccttttatcttggattgcagtctaccttggcatgtgataggtattttgaaggaggtggaagatgtttctcagacgaaattattttaggatgtgataaaacaggggcaaatttttaataatttttaaatgtgtttttgttgacataaagagcacaatgcaatatgtattatcaataaatattcatcaatattcatcaataaattaaatatttattaatgaaaaaccttactcagaaacctcaagatcatgatttaggctgggatagcattaaacatgtattaaccagagacataaggcagggaagaccaaatatctcaataatctcttccattgctttaagttattcttcattctttgattttagacaagaaaatattacacaatttatgcaaaagttacactttaaattcctagattttgaggtcttaagtttgaaactaggtttattcagctgtggtgactcaaaagaagataagagagtggaggactcagacaaaaacgtccctgtagttgtcatcgcctagcctgagaaatgattggatttaaaaggaatttactatgctgaaagcaactcagattaatttaatgtgaccatttcaatgtacactcttgcattattcatgtactatctagatattattattttttatgcaagtctacagtcatttgactttcaaagtatatcctgtagatatcctagacctgatacacttggtataaattatggaattacaccataacattaccataaatctttatattcaaatgcagattgtgtctttctccatagctattcttcttgctcatctaaataatatgaagccaatgtaaattagattcataaatgaaaattatcactattttcaggattaagaagtatattaacatatattaataagctgttttcaaatctgtcatttcatacattatagtttttctcaaaaaatgtgaaacttttttatttgaaccttgaatgaataaatataatgatatattaaattagcataaaatattctgattattgagtataatacgttttcatggtcttcctacaagaagaaaaaaggatcctaattagatcaggacattgattaaatgcattagtgagtaaactgaagctagtatttactgaacaaatggcatattatactttatctgcactatgatctttgtagcaaaataatctattgattgttttatatagaccacaccacaaccatgatttggattcatggctgtactgggaagatgcttatatagatgtttcttttggcactcaaaattatgctgagggttttttttttcttaaatgatttccttagataattcttattatactattcaaacaactttcaaaataagtcactgaattatttaaactgaattattcaatgtttcaggtgaagtgaatactggagagggccagattcaggttagcttctaagctccgacacctatctctctctctctctttcacacacacacacacacacacacacacacacacacacacaccaaattaacacctttctccaggcccataatcactgaaaaaccctatcttgctttaataccagtgattactaaagtgtctactcccaaaactactatgtgttctacctagaattttgaccctacattttacaagtttcaggcagttaaaattggtcataattgctgaaattatgtcacatgtgaaaaaatgggatgcaaatcacagatgtgtccttatacctgtttactgtaaggacagcaagcagagacaagagatagagacaagagaatcaagtttctatttttagttccattgtcactgtcccccaccaagacatccatttatcatttctgaggacaccagcagcaatgttattcctgggtttacaagtacatctgaagactaagaatttgttcttgggcaacatcactttgaccacctactgatttggggtagatgcactaaataaatcaaatgcattcattaaatcaaataaatcattaaatatattgattatagtagccccagtctatgctgtgttcacaaatccatgctggtatttcaggagatttacataatctcataccccaaaggtaacaattattaatggttgctcaggaatccttccgaaaacatctttcttcttaagcacacatacaccaacacacataagtcttttaaaaatacaaaaggtctgtatactctgttctgttctgcaggcagtcttaataattttcatgtaatatctttccatgacaaaacacaagtacagggctcttctttttcatcatatcactaaaaatatacatttccttggtttatattgtagtctcttccccttgtgcaacctctgcctgttttactgaacaaatcactcctgacacattgggttgagttatctgctgatgtcctttcccataaatgttcccttctaatacaggggcagctctaaatcttaagctcctgttgagtactgggagaaaatatctaacttctgcattaatatctaggttttcacacctctaaactagaaaggacatgactatagcctgatgtcaggatctcattacttttcttctcttactttggtatctgatgttccaaatggatattgatggggaaatttatttccaatttaagaatcaagagcaaaaattcatcttctagaatatattatttcctattttatatgctctttcctggaaacttagaacatgtgtagaggaggaaaaactttcctctgccctcttacgtttggagctgtggcatgtgaattaaagcatacaaattgtattaatgtttttaattttacatgcattggaaccacacagaaaagaagtgaaaaacctaacggagttattagactcaggggcttatatactactttaacaaaggattatatatttcggaaaatgactaggaaatatatgggaaaactacgatgagaagagttatttagtaaggtttgtttatgcagactcatctctcagtactatctttatttcccgtaacgagggtttttgtcttcctgagatgggagaagggaacatttccacaaggaaaactaatgtgatacttgtagtcagaaagtgggagggcagagagctcttactgtttctgatttctctcaattaccttcagttataaaaaatcattttccaaagtggtatattttggtgtggcatatttggtcccttcatatgattatgttccttttttctatctaaagatggtatcccctaagtacatccttgaccttttttaccttcttatattagcacttgaggaaataccaaaaataataaatcgtataacctattactgatgaaatgtgtatgtttctttttgtcatgtatgtgtggtggaggaggtgcatagaggatatttctctgtaacttctagcttctttattggcaagcaaatagattggcaagcaaatagatttatttctgtgtgtgttttcaagtcattgtgattagcatggactacctttgaaatagccatttgagggtccccagagtctataatttttgaaataggaaaatttcaggatattagtatttttctgagtttaaaagcataacctaaagttaacttgtaggctttttctttctaatgctttttactgagtggtaaagatgagcaaccttttttttgtttaatagccagatactttttatactccgaatacaaatattgaaaaaaatgaaaggaaaaccccctagatcaaacttggtcaatccatggcctctgggctgtatgtggcccaggatgactttgaatgcagcccaacacaaattcataaactttcttaaaacgttgtgagatttttttttggcaggttttttttttttttttttctcatcagctatcgttagtgttagtgtattttatgtgtggcccaaggcaattcttcttccaatgtggccaaggaaagtgaaaatattggacatccctggcctagattgtgagaaaagagatcccattacatttatgaatgggctgtgctgaaaattgacagcaacatcagaatcctaattgtgtgccagcagaaacagtgctattagattttctctgtgcttagcaaaggatttagttagggcattcactttcaagcacccgttctatgcattacacactctcatactgtcttaaccaataactatttctataaggacattctggtgaaattagtgtgtccaataatttaaactaaaatggtgacatctaatattttctcctccaaggtaacgtcagcatttcagagcactttcactatctgaaaacggccaaaaactgatagaagagctttctgtttacaactttatacaccatagtaaagttctaggatgcaaagcttgcacagctttgtaacataagcattttatgccaaattaggtgaggataataagatattgtgacatttgcccaaagtcacggaacagtacaaaactcaagatttgaacaataatttttctgactacaagaatcattccatttctgctggctaaatcaacaatgaaatacaatagttttgcattgcgacttagaggtaccccatgtattccactaaaataatttgtattttgttagaaattaaaatataaccacatgaaatatgtctgtgggtgtctctctctccctctctctctctgtacatactgaatttctaggtgtaataaaatgcggtcagaaagagttcctgcggtaccacattatttttttctttttgcaacatgacactacactacttctaagggctaacaaattttaaaactttcaaaaaacatgatgagaaaattgatgaaagcctaccatatagaagcaagaaggaggtttgaagtgcctttcaaaacagattaccagtctgtcattttgacaccacgtaagatggccgtagaattatccatcatcgagagtttcttcatcaagaaccctaccctccatctgtatagagcttgcaaactaaagcactgccttgttcagagtcttttctattgccttaaccctgtcttcttgtgactgcctttctaaattccacatgaaagtccctttctcaaggtataattttatgtaaacttttgagctgactttaagatttgtgggcatattgtggaaatactcagacatacccagcacatttttccagatgttccaggtgttccagaggtcacagctccatcatggattacaaggcttttggtaaagaaagatggatcaaggttagagagtaaaaaaagaaaggcctactcctatttgtcacttcctgtgaaatgcagaggctcctacctaggaagacatttttcaggtgctgagaggactcttgggattttatttattgtgaaagtttcatttattttgaagtatcattctaaaaacaagattaatgctcaaaatggataatcaacattatctggtacaaaacacatggacttacatgttaaaggtgttgttctttccttatcatctctgggaacttggacaagtcaggtaacgatgtatatattttataagacaatatattgtatacattacatgtacatttgtgtgtgtgtttatgtgtgttctctgagaagcagacccaaaatggtacttgtcctatttcaccctgaaaacaactcccaggagacacatggcctcagcatgaacctggcagtggattcagaggggcagctggatccaccatgcaactattggtcagccgctctccataacaggatctcttgaaggagatctaagtaatgcttttccatgtgccatagtgtatgaaatagaagatctgcacataatttagaactatgagagaaggtagctctgtacattgcaaggactcctgaagatctcattcaatgccgtcattgaacaatggcacgagcagttattaatgaaaaccattggtcagagactttaaaacttcagggtacccaagagtacatttcagcgtttgctaaaatgctattaccaatctcaggaattaggatttaatgaataagtaatgaggatgaattttaacaagcaatcaggggcatcctgaactgggtggtctctataccacagtctgaaaagtactgaccttcctaagcgatgtagaacatacaaaactgtactcattatagtatattctacttaagtggattatgtatgtcaggttttcatactaaaaaaaaattactctggggaattaagagttattttcatttattcagaaaatcatatatagtctatgatattatacaactgaggcatcaacaaataggtaatttttatgaaagttcagaaaggcagtagggacttgtaggcatttggagggcttcattttcccatgtcaattggtatctctctgttacagtaggtgccattatctactttaattgtaatgaatcactgggggaattgtatttgtgaatgacaggtactttcttatgcaaatgaattgcccgcagtgagctagtttagttgatcaagctttccaggtcaagtagggcatttcccagatatgataaataaatatcttgggagctaaagaggaaatcattacagcatatcattctatctgaatttcaaaaagtatttttatatttaatttgttccccaaatactttccagattgactatatatactatttcttgaaatattcactacattactgaacactatcatttttgtgtcattcagcctcacagaaatgttacccaaatgggatgagtgctccagtgaaaatatgaaagccatatgaaaggcaggttcagtataaatgcaaattgctttatcagaaacattgtgaaatcctccaaaaggtactaatttaaagttagtagaacacttttaaagtggcttttaatgtcaatatccctgtaattgtcagtatcctgaaaatagtaattatgacagaattataatttaacaacagtagctttcttagtttgatatatttgagtgacctaattaaagtcattcttaattgttttaccgtttgatttctatgttacaaacttgaatgagagactgctttcttggtgcttagttaatctaggataatattaataatattaaaataatagaatagaacattagacttcagttttgtttctattaataatcaaagttattagtttgtggtttgtatttttgttttcataactgtgtgaatcatacatttattttccaaattatgtgcaacctgattgaggaccccttttaactttacagccaaagtacccagatggcattctgaagtatatcttacaaataacaaggtcaaataaggaggatgcacaggccatttgacagatataatttgttaaaactttatgtttttgtggaaaaccttataggaaataatttctaatgttctaatgtaagcttatgttagatactctgttagacattgtctaccaagcttccatggttttagaatcctgattttactctaactgtgggtacttacatatgaatctacagagaaaagtcctttctcctgtgtgaactagtagggaccaacgactttaaattctctctctaagacttgaggtcgccgttcaaagaactaactgctgtcaaagagcccacagtgtgttcattacttttttaagatacgacaactttgggaggctgaggcgggtggatcacgaggtcaaaagatcgagaccatcctggctaacacggtgaaaccccgtctctactaataatacaaaaaaattagccaggtgtggtggctggtgcctgtagtcccagctactcgggaggctgaggcaggagaatggcgtgaacccgggaggcagagcttgcagtgagccgaggtggtgccactgcactccagcctgggcgacagagcaagactccttctcaaaaaaaaaaaaaaaaaaaaaaaaaaaaaaaaaatatatatatatatatatatatatatatatatatatatatatacgacaagctactgatttaagggcaaggaggagacgggggaagtatatttacaatcttcaaaaattatcttgtggatactgaatacctaaaaagaaaagctcacagtgatctattccccccacccccgacctcccacctaggtagtttggtagtttctgctgagatcagaaattttttttttattctgagacagggtctccttctcttgcccaggctggagtgcagtggcactatcatggctcacaacagccacaacctccagggctcaagctagcaaagtgatactgttagcattcaaaacaaagaacaaattagtaatgggtgttttaatattaaactcatcttactgtggtcattatgaccattaactcttccgtacgaaagtattttgaagtgaatcatcagggactctgagtcagtggtcttgtcttgatgtctcacaacatgggtgcctctatttatttagacatctatcttcaccactcactttcaagtgaaagtgaaagagcaggtcatcaaatttcagtattctgttattttttgcagtcgggagccgtatggaagctagcccattacctaaattgagatgatagaatttgcctattgaaatctcaaggactggccaggtgcagtggctcacgcctgtaatcccagcactttgggaggccaaggcgggtggattgtctgagctcaggagttcgagaccagcctgggcaacacagtgaaaccccgtctctactgaaatacaaaacaaaacaaaaaattagccgggcttggtggcacgcacctgtaatcccagctactcgggaggctgagacaggagaattgcttgaacccaggaggtggaggtggcagtgaactgagatcacaccactgcactccagcctgggtggcagagcaagactccatcacaaaaaaaaaaaaaaaaaaaaaaaaaaggaatctcaaggattgaaagactgacccattgcggtgttatcacgtccaaaaaaagtaggcatattcacatactgttttgagagaattaggaaaattttatgagaaagttatttggaaaacatacaaaattaaatgtatttttccactcattttcaaaatgtactttagcacaagaggcctggtgcatagtatatatgagaagtatttaaatgaagggatacattttgtatgatttttcttacaaattcattaaagtatttcaagtaatatagaataattatttaaccagtgttgcaatggctattaattttccttatggaaggaaaatagacaaagacgtattattgattttcttcttaatctttttaagtttttttaaataaattggaaaaatacaagtttatatgtagatttacttatatttgggggtttaaataaatgttctgcatcgctttgccgcttctcaacttgccccaaagcaaaacgaacacttccatggtgtctcttggaactcctctcctttcatctcccaaactgtcctatatctttgaagtcgtttctgaatatatgcctcatctccttcctttctgtgaaatctgacagtttgtcaaaaacacaaccctggtagccttttataggtgatgacaatgttttattccatttcccacatgttatagagccagtatataaagtaggtgctttacttgttcctcattgctacttcaaagtcatatctcaccttttctgcttcaaaaacccagaatgtttgaagctcaaagtcatcgggctgtacaaatccttcccccttttcattgttataacccactgacatttgtcattctctgccattcatttaaggctgtagattctggctcgctctttctcttcatctctacctctgcctctattctagtcaccttccaaatccacgtggccttaaaaccacaggctttcaatcccttgtcttacttgtctccaatatattttccttcaccctaactcagatgatcatttaaaggttgagaccatatgctttttcatcactcttatcagcatccccctaagatcaatcatgattccaaaagttccacactcattttttctgtctcctgatccatggttaaaacaacctcacatttgtcaattgtttttatctctttttaccctctatcatctcctcctattataataaacatagattaccagtccaaaattataatcactttcttgcaaacaaccttaactattttacctttgtctttttgaatcatgcttatctatcaaatctgggttttattcagtcatttgcttatttttatctaaaacataatctccccaaaggtacacttatattactgaaaaacactatttcagtttcctactctgcatgattattttatatcttctattgtctacataagtttaagttggctttatcaaaagcctttctgatctccatagccaaggaagttccatagctattgatttcaactcattggtactgggtgatcacagggaatctcagtgatcagagattaggtaataatatcttcccggtcaggaaagtttgaagccagttggctatctttctttctatatgacagttattcatacacgaaggtgtgaaattttcaactacctttcctggaatataattcatgggtatgtatcagtaacaatgtatgtctccttttatgaacatcatgggcaaagtatgaaaacaaaacaatcacctcttaaacgtgtcaatcagttaccatagccaagtgcactgtgacattatgattgtttcagagcggggagcatttgctgtgcatcattttatcctgaatgtttttcctaaccctgactcatggtagtcgtcctcaatatgtatttatttgaaatgtatgttttattttcctgttagatctcgtaaatatcagacttccgaggacataaatctgttaaagccttgtctcatgtttattgtttttgtgtatctcttaaggaaatgatattttgtttttatattttctgatccgaaaagagcaaaagcccctgcactcgagagagctgttacaatcaaatgagaaaatggaaaggcaaataaagaagatgtgattccctacagctgtgaacagtgatgtggaaaatatagtggcttttaggtaatatagggattcacatcctgtctctaccacttactgcttgtgtagcattgtaaaaacaacactaaatctctctcagataattaagacacggaatctgaaacacagtgggcacttgatacatgttatccctttttatactcctacctcttcgtaaggaaatatttctgagacagaataaagttcagaatcaaagtaacaagatgcttaagccattttgacagaaaatagcaaatatgtggaaaacataacaaaatatcaaacacttatataggttaagggggatgtgcccaagagctggaagaagagagattttctctataaatgattcagctaagaaattatagaatgataatatgaagctattcatctgtattcaaatttttatctaaatgcctaagattgacatgcaatatatgtttgctcttaaccatttgtaggaccttgataacatttaaaaataggtttacattcattcatttcactctccaccacattctctttttgaatctctctctctgtgcccccttctggaagcctcttttaattacttttacagagtggaaattgtatttgttaaaatatgccagccctcgatattcaaataaacatattccaattatggaaaaatgtgagatggaatatatttaataaaatgaggtctctaattattttttcactgaaatttgatcatgtcttttttttttttttttggtcttagtttttaaatgttttatttttattttatttttatcctgactgtctgcatcctacttgctcaggtaaaaaagtaagacactaaaacttgtttaaagataaactattaacaagtgttaacttaaggaaacttctagaatattttccatttggaagtctatttttcacggaaatagagccatgttgtttatgttaatttgtacccagaattttctgcttactgaaacgtgatagaaagttctatttcaatacacatatatctaactacatcattcattttcaaagaccttgtggtattccaggatataaatgtaccataatttatttagctaatattcttgaaactttttgagatgattcaaaatcaaatgaatttttagtcataacaattctctgaacatttatcacacacagcctagtgttttcaattgttttactcaaaagagaaagtcttgaaaaaatacatcagatggtaaaatgtcaatttgaagcagtgttttccacattaaaaatattgacatttttctctttgccaaatttaactggcaatttaaataacatttctgtattcatttgtcttttattgatagaagaatcaatagtattagtcagttgggttagagtgggaagagctggaggtctggaggcaggtcctgggcttagacgtggcctttgatgcttgatgttcaaatgctaaaggcattttccctgttttcattgggagagggtgagtgattactggagtttctatattctggcaccaactggccttcttatttcctgtgacacggagagcaaaatcatgaaaatgttatataccagaagcagagaattctctcctacctccaaaaagcagaagttagcaaacactgagctttgtgcgtaagtatgtgtgtatatatgtatgtaggtgtccctgaagataatttacatttttgttttatatgttttgaaactgttgaatttgaaacaattttagtttataagaaagttgcaaaattatttaatgaaatactataaacccttcacccagattctctttcactatgttttatgtacatacacatttacatacattaatatatagctattttttctgaaccaactgagaataagttgcccacattatgcccttttagctccaagtacttttattgtttatttatcaatggcattcacttaaaaatcataatacattgataaaaaagaaaattaatgtacgtaaaatgttatcaccaagactagaggtcatattcatattttgccaattgttctaatgtcctcaaggataaaaaaaaatcctggtccttagtctaatctagattcacacagtacttttatatggcatgtctgttttgtctttgtacatctagaatatttccataatctttctttgtggacttgatatttttaaggagtacgggacaattattttatagatgctgctccatttaggtttgcctgatattatcttgtgattaggtagaggttatgggtttttttttttgtttgttttgtttttttttgtttttttttgttttttttttttctttgatggagtcttactctgtcacccaggctggattgcagcagcatgatcttggctcgttgcaacctccgcctcccgggttcaagtgattctcctgcctcagcctcccatgtagctgggattataggcatgcgccaccaagctcagctaatttttgtattttttggtagagacggggtttcaccatgttggccaggctggtcttgaattcctgacctcaggcgatcagcccgcctcggcctcccaaagtgctgtagttacaaacatgagccactgtgcctggtaaaggttatgtatttttgacaataatactatcgaagtgatattgtgtttttcaatgtgcaacaaaccaggagccacataatgtctaggggttccattaatgatagtagttacttagatcatttgattagggatagtgtgattttgtcatttaaaagtatttataattttctgtatataaatatatcttatatacgttttttcctaatgtttggcatccactgagttttcttgactgaaaaaatttatgatttttttctatatggtggtttttctcttcatttttttctatgctaattaattactgtaacaaagcattttccattctttcccatttattcattcatgtgtttatttatttatttatgttactatagactcgtggattcttattttatcctatgtcttataacatattactattaagattcgttttgatgatccaattttctagatttggccagtgggatccagttcaagctggctcctgtgtctttcaaaaaaagtcatcattctaggaacattgtcttattttttgttactgtaagtttttccaggctcattttgaacatatcctgctccaattcaagaatgaagtatttatccagtgtatttccttttagtaaagaattatattaaggcatcaggagctggtcttaggtatgctcattgctactgtaatgacgtgtacatacattttcaaaatatatttaaagacactttccagtatctgtctctagctctttattataatccattaattcataggatattcccattctcatttaatattacagggtttaattttgccatcatcctttctgtgtttttatattcctactttaacattgagaaacctggattccattacccataatgtatttactatttcctcagccttataagagacgtaagtagtttgaaattgctaaattgtgccattgtgaaaagcaaaccgactcattacatttcaattaaaaatttactttaatcagagagtatatgtcaaagtacagatttcaagtactatttggtgtcttttttttttcttttcagcacatcttgactattaatttgaaacacggtttttctcccatgcttgtagattccagggatttgtttttatatgtgaaatatcaatatataattctaaaatttaaaatgatacaaaaatgtataataaaggaattgtcaccgcttctcaccttttcaatccatttttaaactcttattcttctttccaattctcaccctctccttacagataaccagactccttagtttatctttccagtgtttctttttctcacatatctgcaaatacattatattgtatctccttctctgttacagaaaccttagcatccctttgattccttttgcactttgcatttttcacttaatgttgtagtctggatatcactccaaattacctcttaaagattttctcattttttttttttttacaactgcgtaggactacattttatggaaataggcaagtgtactcaacctctctaatggataagcacttcaattgctttcaagttttagcgattacaaacaatgccttcatggataaccttgtttatatttttgaagttggatcattaaggaaaatgtcgagacattcatttccgagtcaaaggtaaatgcatacatagttttatttatattgtcaaattctcccttataaatgttggaccaatttacattcacaatagcagtgtttgagtgtgctagtttcccttgaactttgccattgaaatgtgttgtcatacttttaaatttttgttaacgtgaaaggtaagaaatatttcagtggctcacgcctgtaatcccagcactttgggaggccaaggctggtggatcacctgaggtcaggagttccagacaagcctggccaacatggtgaaacccagtctgtacaaaaaatacaaaaaaattagccaggcatagtggcgcaagcctgtaatcccagctacttgggaggctgaggcaggacagccacttgaaccctggaggcagaggttgcagtgagccgagattgcaccactgcactccagcctgggtgacaagagagagactccgtctcaaaaaaaagaaaaaaaaaaaaaaagactgggagcagtggctctcgcctgtaatcccagcactgtgggagactgaggcgggcagatcacgaggtcaagagattgagaccaccctggccaatgtggtgaaaccccatgtctaggaaaaatacaaaagttagccaggggttttggtgtgcacctgtagtctcagctactcaggaggctgaggcaggagaatcgcttgaatccgggaggcagagcttgcagtgagccaagattgcgccactgcactccagcctggcgacagagcgagactccgtctaaaaaaaataaagaaagaaataatatctcagtatattttaatttgtatttttataattgcgatgaggttgatctttttttttttgtatttttaaagttcattttttgtctatttttgggggtgattttgtcttttgctcatttttctatcgcgtacttggtcgttattctaaatcccatcactctcaatttttttttctttcatgtttctgctcattcccatggagttaatctgggtatgttctccacttatgcttcgcccaggctaagctgtcagtcagtgcagctcattctgctacccttctgctagccctgtttccttgtcacctaaaatacactttttaagtttttaataatgttgagtcagcattaacagaataaattggccacattgggccaattagtgagaagtctcatttctatttttgtggcattttaatcctttcttattctgtgtttctgtttccttggtgtcaatattcttatatggatatgtgatagtcttccttagtgtctttctactgtccatgccataacaaagttcctttctttgctaaatgtgagatgtgtacaagtaatatcttacatggatactttgcaacaattgcatgctatatgtattttcaccaccccttagttcacagatgaaaaaccacgttacagagagataaataactgaattcatacagcaagtaattgatacaaccaaattttcaaaccaggcaacctgctttcagagtttgaactcaaaaccagcaatatatatgctgcatcagataagtgtatttcattgattttgaaaactcaaagacatataatactgcatcctaagctttaaaaagacaaaagtttgttggctaatgtattaggtaaagaagttatctgattttaataaaaaagggcaaaagtaggctgcagttcatatattaagtaattacaattctgtggtgtcattggtcttgaaaattaatttatatttaatttgttatatcagatattaattatacttggtagaaggacaagaattaatacagaattcattaataaaagagtgtgctggtttattttaaactatccttagattgtatctacgcaatcaagggatatttttggtctatttgatgcgagaattatatgatccaaactgaaatgatcactggggaagtacattttcacctgataacctttatttaactgacacaattatatcaggcatgaactagtacaagtatgcattcacagccacagccatgtgcatactgcataacatctgccagactggaggcaccatgagtcactggagtaaaccaggagcttagctgacattgtcacatggtcattatcctttattattgttaagaattaattttattacaaatgtgaactaaaactaatttgaaataaaacactaataaaatgctaattaaataaaacacatgccagtactagttattaaaattagataaaaataatcagaaaacaaatttttatatcatcaagtattgtttaaatcaagtttactgtgattgaaattaccttacggttatctgtgtgacacagagatgaaggctgatcgtcaaagaaaattctaggaaacatactttttctgacgttgaaaagttgctttctgaggagtctttattcctgcagagaaatcaacacaaccgggaaactcttgtctctcatgcctgctgtttgcttattttacacaagtgacattcatcatggcttagttgatggaaactgagcaatgcttgaagttttaagactacatctgcagagcccaaataagcagaaagccttaaaataatctcatgaactcaatatagtcaggatagaataagccaggaaaatcccaaatccccatttaacttaatcaccctaacagttttaatggcacacttgtaagaaagtaattctttactggtgcccaacaccttctgtatacttcattaagggtaaaatatatggttgagtctttcacatagtccacacttcagatcgcccagaatctcattctgtgctcacatgttttgtgtgaagtttggaatcagtagggttttcctttgaaagaactcactcctccacctgccatctcgctctgtcatcttcaggtgaatgccaaatattggttctgagttaatgctgtgtggtgttgttattctaacatcccaacaggaaagtgccaattaaagggaaaaagtgttgaaaataaagttattttgttaaaagaacatacgtaggaatgcttctctcttaaatatagttatggatcaaaatacagaaattaagtgtttgcataatggaagactagacaatttgaatgaacaaataatgtaactataaatataataataataacacagaattgttattcagtatacttgtattttacatactgccttgtagggttatttccagtgattaacgtatttcacctggcatttgttagcacacaactgactgccaccaccacaggacggagaggggagtcggtgggcattaaccacagtgtaaatcaggttgtggaaatgcagaggcagtcacttgccttggcactcacacatctaatgtctgaagaagccaggacgagttcctatgttgtacattctcagtctagtttttcttactggactcgataaggaagcagaataattagatctatggagatattaagtatgagtcaacacaatgcaaaaactatcaaagtagccaatcactctttgtctttgattgttgccaacatcttttttctccaactcttattttggattcagggagtacctgtgcaggtttgttacctgggtatattgcatgatgctgaggtttggggtaagaatggtcctgtcacccaggtactgaacatagtacctagtagttagtttttcaaaccttacctccctccctcccccatatagtagtcaccagtttctattgttgccatttttaaaatccctgagaatccaatgtttagctccctcttataaatgagaacatgtagtatttggttttctgatcctgcgttaattcacttagggtaattgttgccaacatctttaatcagagatgcaatgtgtagaaatatgttagcaatggaagcatattgaaaatggacattgatactgtgtcattttgttctctcttaatgacaaggacctatctaagagagttaagttctcctttgttccaaaacaacttgtagagttgttgttcctttttttttttttctgattttagaaaaaaatatgtgccattatggaaaacatgaaagtggagaaaaatattaaaagaacaaaaatcacccatagtctcaaaaccccaagtccattccctgaagcatttttattatactttcctccaatatcttgtgtgtgtgtgtgtgtgtgtgttttatgaagtaaaattatgcagtcctgaagggaatataaagcaaaccatttcacttttccaaactaaattattacggaccatttttctattgaacaattacatcactcaatttaaatacaaagtattttacccagctattgtctgaacaaatcaaagctgtctaattacagtattgtatattgtacttttttaaaagcttgatatattcaaagatcaaaagcatgtaacaccacacctgggttgccatagagatgtctacattttatcaagattaaaaaaaacttaacaataaatgcatttttataggtatgctaaagacttaccataacttaaacacccacaaacattttttttttttgcatcaatattctgggaaaaatacaggtgcaagatattatgtgccttttaaatagcttcattttctaaacttacgtctttttttcttctgatgcatcctttccactcacctattttttagtttagaattgtcagtgaaaaagttatgtttttcaaactctggaaatatggcctgccaaactgatagtgtgaagtatggagaaaaataatgtgtatacacacattgcacaacatgtacatgtacatacatgtatatatgcacatatgtaaacacagatatgctatatgtgtatgttatatgcatacaaatgtgttttttatatctgtttctactctatgtatatacttacaaacagagcacaagcatgagattcttaaaatgtacataggacagaataaaggtcatctgatctagataagagtcatcatacatattcatagctctgaaattatctgagagtttggggaggatatttctctagggacctttaaccttaatgtcagggtgttgatttgacaagcatctctaaagaatccatcactttattagaaaaagcaaagtgtaacattattatttttttaacaacccaaactttaaaaacctttggagtaactcttatgagaaatacctgacttttgtaagccatgactacagaatttcatgttggcagtggcagaaaagagagtgcagatggagaggagcctagctttccatctgtcatagcagcatgcagaagatacactgcttattgcttcagctgtttctaaatgctgagatagagtcttgaaaaggaacaaactccaaactcatggttctttaagcagaatttgtcagctggattcaaaagaagcaaaaatgttagcatgatgaaataatatgcaggtagagcctgagaaaacctattaatatcaagtaggaaatagaacagtcagagcatggtatagtcatgttattgaacagagatgtaaaggggagaactataaattcttactgctgaagtactagccctgcaggacatacagactgcatgaagcccaggcttcctgggattttttttttttttttttttttttgagaaggagtcttgctctgtcgcccaggctggagtgcagttgtaggatcttggctcactgcaagttccgcctcccgggttcacgccattctcctgcctcagcctcccgagtagctgggactacaggcgcccgccaccacgcccggctaattttttgtatttttagtagaggcggggtttcaccgtgttagccaggttggtctcgatctcctgacctcgtgatccgcccacctcggcctcccaaagttctgggattacaggcgtgagccactgcgcccggccttttttttttttttttttttttttgagacagagtctcactctgtcacccaggctggagtgcagtagcgcaatcttggctcactgcaacctccgcctcctgggtttaagcaattagaggtgtgtgccaccatgcccagctgatctttgtacttttagtagagacggggtttggccgtgttggcaggctgttcttgaactcctgtcctcaactgatctgcccgccttgacctctcaaaatgctggaatgacaggtgtgagtcatcacgcctggccaagtatttttaaactcttggtttctagtgttattctcatcttcctattgctctgtatgcatcttttggtaactcctccctttacttgagctggcctggttctctactctttgaaccactgaagcttaactaaaaccatgccctttctaaccacagtccatgtgagttcccataattttcttgggttgttgtaaattaattcaatcatctgccatccattcatccatgtaatgcaggaaccacggtgtcacttcattcttccctccacttcactgacttccccgttttccccatctccaccctagaccctgtctttccacctcattttcaggattaattagccctcttcctccttaatagtaccctctcagtatagtcatatctcttccctgaactaccatgaaatcttggaaactgtttttctcctaccagtcttgtttctttatcattccccacatttaattctgagtaattaatgagacataagaggactttttgtttttctgattaaaggtctatcccaagtttctcatcatcttgtagtaagttctccatggcttggttctctctacttcagctttagctcctgcaacacttcctgcctctgattcagttgctttccccatgtttaaattcttgtgcacctccctcttgttcttcaacacttaactaaatggtcatttctttttgcaacaaggctttcttaaacactctatctggaccctcctctgtgcttccaaatttgtactacctctaactgagcacatctcattgtctgttgagtaaatatcttaattggtcttccactaagctgtcagcttgttaatggtgaggacttttttatagtacattcaaaacctggaacaatgcctggaatatgccagtgaccaatgaacgtttgtggaatgaatttacctcgggcattgcagttccttagatgtacgtgacctccagggccctctcacattgtccccttgatccatgattctctgcagcagtgttgtccgtggcggcttgtttacctgctgtgccagacccagtttgtggtcatcactgtgtccatgagaataaacagacacagctcagagatgcctagaaagaaagctctgtagaataagtgggactcctgcatggtttccctgagaactggttttgctaagatcatcttttgcccttcagttttattgtacagcaccttcaacattaccttcctgtgattgaccatacatttagaagaatccttcagttgccctgctttaagaacacaatcagttattttagaaaggtaagattgataccaacatgaaaggctgagcagctgtaccgagtgcagagaaataagagtcacctcaggcatcaaactgttcatagtcagatttagaggaaatcaataaataaacttgctcatactttactatatttagttttgattcattggataaaatatatctttaaatatcatcataagaaagtgagtgtttggtaccattttagagtttgaatttgaaaaggatttcaagtgtgaggagtcgttctcctctggagatatttcacaggcaccatcattagtgtcaagtggagcagcctaggggggcccctttacatttattgtctttgttcctaaaagatcaaacgtagtttttccttgtacgtacagaagctaggagcttgccactttctcaggaggtgctagctctggctgaattcaatttgtgttcagaactgcccgaagcagaatttcatacatcaccagctcaggatctcacccttgcaattatccatgttgaaagactgtggcaggcagaataatgatcccccaaaatgtccacaacccccagaacttgtgagtctgccaccttttatggcaaaggggaattgaggctggaagtcagttgagagagcatactggattatccaggtgggcctaatgtaatcatatggacccttaaaggcataagaggaagaagaaaagccattctaagagatgtaataaagctagaggaagtgacgcatgagctcaagaacgtgagcaccctctagaagctgggaaataccttcagtcacagtcagcaacaaaacatagacctcagccctacaactacctgcaaagaactgaattttaccagtaatctgaataaacaaggagatggatttttccttagagcccctagaaggcctcctcactgtcatctttattttattcttctgaaactcatgttggacttgtgacctatgaaactgtaagataatacatttgtattgtttgaagctactgactttgtggtgatttgttactgcagcatggaaaagcaatacaatgagctatcaaaaacattgatcaccttatccttgatagggccaggaatgccttaaagaatatcacaatctaattgccaagaaaagataaaaataaatggaaatttcaacaatgataaaggaacaagacagtattttgagacggtaattggttgaatggtgtatagcagtgcatgataaattggcaaataaattctgctaagttttcagcaaagtcttaatgaaaagtcagaaataaatgagtctcaggttcctaatctcaagaatattttagacgctaagcacagagttgctagatagtcttatgaaaattgcttcatttaagagaaaatggcatatcattaagttgaatatttcatgatattgaaatgtagggactccagttgaatttgtcaggaaaatgggaagaaggagactgcatgagaaccaaacttaaatgtacagattggaggatttgaaaacggttgagatggagaggctttccagaagagaacaaattgatgagcatttcagagttgacaatgtctacattacctcctgagacatcaaggtcaatgcacatgtgccgaaagccactcacaaaattgaagtccatcctccaactccaggcccacacttactcacaagcataacttcctcacctcaacagtgggcagtacataatttctgaaaatgagacaatacagagtaatctctcatgcatctttctttgatgtaacagagaccagcctgagttgtaataaatttagggaaagcattcactattattttggtttctaactcttctcaatctgggacaaaatgaatgccactgaaaggcaagaaaaatactcagataatctctcttttccagccaaatatgggagtattgaaggaacaaggagatgacagataaagatgcttttagagcagctcctaatgctctctctctctgttcctaaatgaatatggccaaggctgaggaggtttctacttatgagaaattgtccctgaaagtactccagctgctcactgactcccaggcctaaggatagtcagtctagaggaagatgctgcgtctaatatctcttcctgcctagggttccgtagagtctagtttctgtggaaagccatgtatggcgataaaatgagtgtgatcctcttagcaagaaggcatgggtggaatttctgccttccgtgtttgctaataaggggacttcatgccaattacctaacctctctgggttttagttttttcatttgtcgatggcactgatgatattaatggagcctctctcagagtaagcacttatggatttttgtatgatttttaatgcgatgagataaatcttcagtaaaatttgaagtattataaaatgttagtattcttgtagttattattgcattaattttctagggcttctataataaagtactgtcgattgggtggcttaaacagcaaaagcttatttcctgtggttctggaagctggaagtttaaggtcaaggtgcccacagggttggtgtcttttcaaggtgcccacaggattggtgtcttttgaggcctttctctcgggcttgtagatggccattttctccttatatgctcacatggtgttccctttttgcaggtatgtgtccaatatttctcatatgagaactccagtcacattagattagggctcaccctaatgatttcattttaacttacttttctctttaaagaccctgtatctaaatgcagtcacattctgaaaaactggctgttaggacttcagcatacataattctagggggacacaattcagctcataacattattacaattattaattccagttcagtggttaaaataatatttttgcattatgacagtcataactttatctattaaaaaactgaatacctatttcacgttcctttgaggctttataatcacaaagtcaccacttctcagaaacaaaagcaagctggcagccttgctccactgtctctcctttgctcaaatggccactgaaaccagtgccttggcctctgtgggctttatcacctttgacatgaaatactctcttcacagtataatctcattttttgtgcaccataagggaatccatttgaaatgtagaagttgactccaatgacaaaatacatatgaaaaatagtaactttctgtagtaactctaaatttccttctgggaaaacacacaaacgtacacgtgtacacatacacacacacaaccccccacccctccaactgctaaaattttcatgcctaattgatattttccagaaaaccatttaagctgctttcttctattatggcttctctcctaccaggcacagaaactgtactgaatattagggataagtttcagtagccccatttgcattcagtcctcagacaagcgaagacatggacagtgagtaacatttatcctggggaaactgatcaagaaagagaagccacctggataaaacaagtcaaggaaatttgcatactcagaaccatgatttgagatgctaatcattacagaagcatgttttattggtccatttaatttgatttggagagaaatctccctaaaggatttggggattttgcagacctaaggcactgacatacagagtaaagttggattttactatattacttgtccctatggaatcagttcatcaaggctgctaataactaaagcagtggctttcaaacttgaatggctttaagaattatctggagagcttgttaaaatgccacaggctcaaggaattctaactcattcagtcctgagtgggatctggaaacctacacaatatcaagcccgcttcctcaccccaagtgattttaatttttctaaccaacactcacatagtgtttattatatgtcagacactgttataagcattttataaatgttaacttatttcaagtcacacaatttttacattttttttcccattttttacaggagagcaatggagacagagttgcttatccaagggcagtctagcaagtggcagagctggggcatgagtccaggcagttttgttccagagtccgtgctcttggtcaccttactttgatgcgtatcctccaccagcacactttgagaaacaccacagtaaggaatacgcacacagatgtgacaactgcccctacaaagcaaatcattcctgtcaattatggatacctgtctcatttattgaaaacctacttcgtgccaaggactctggtagacagacaagttttttaaagcattacaaaataagtgtgaaaaacaaaatcctaaatgagtcttgattaacccaattgggtctctctgtggcctaatggtggaaccaaatgatgtagcagaaggaaagcaatgtttctgtgtttccaaatgctcaaactgcttctgagtacaccctgggctccatccagtgcagaacttaagaatttgctcctatgttttttactttttcttttaaaccagtatttatttggaaacaatttcaaattgacagataatatttaaagaataagagtagtataaaagaccttcatatacatttcactcagaatcactgaccattaacattttacctcattaggtccaacagttgcaaattctctctctctcagtttctctctgtccacataacgtatacacattttttaaaaattaattttaatttttgttttaagcttcagtgtatgtatgtacaggaagtgcaggttcattacataggtaaatgtgtgccatagtgtttcgctgcacctatgaactcatcacctaggtattaagcccagcatgcattaactatttttcctaatgctctccctcccccactccaccccctggcaggccccagtgtgtgttgttccctccctgtgtccatgttttctcattgttcagctcccacttataagtgagaccatgtggtgtttggttttctgtttctgccttagtttgctagctctacccatgcccctgcaaaggatatggtcttgttcctttttatggttgcatagtattccacagtatgtacacaattttttaaccattagtgccattagcattttcttatgggggaagtattggtactttgtcccagcaaataaaaataataaatgaaaaagttggttagagtgtaatatatccacttgtcacaatcattttagcagctttagaaatgctattactgaaattatttatctggaatcagttatttcatcatatcatttaatttccaattgatcattataatcaacattattatcataactgtttttattgagcacttgttatgggcaaaaggctttttgcattatcttattaatccacccaatattataatattataataatcctctctgtctctgtgacagtaattcttcctatcttcctcttcacatgtgctcctgcaggcacgctggcttccctgtggatctatgaacattccaggcacatttcggtctcatggcctttgcatctgctgttctatctactggaatattattaatcatgatattaataaatgaattcttgcattttcttcaatgattcactcaaatatcaacactttagtgaatccttccttttccatatcatttaaaatttcaacacttccctaatattttctttcccccttcattgttgcctcattcccatcttacatatgtcaattacattttttttcccttaaacattagtttcaagaggccaagatatttttctattgggtgtattcctgtttagcaacccagagaagtgtgtcagccatactgaggcctcctttaaatatttgttgaataaacacccattgttaaggtacggaaaatgaggcctagagaggttagatcacttagccaaagacaagtttcgggaaagtgtcaaagcaaatatggtatcaggaaattgcctgtagggcctaaattctccgtacgtctagtcagctgggagaaacctgaggaacataattgagtttcgtcttttagagttttacattctagagcttctatgctcttggtggagaagctgatgcacacacttaatggctctgatttttgttgtcacttgtgcccagcttaactatggaaaagaatttgatttcataagaataagtgctcttagtagtagtactagagacacacctcccatttgcaaatatacttgctattttcctagtatttttacatacattgtttcattttacttcataatgggacagtaaatccaggttcattatcacctttgtgtggatgaggaattggaagcccttttgggttagtgattttctcgaggtcatacagcaaaaatgtggttgtatcagaactagggccaaggttcccaatctctgacctgatttttcaccaacaattttcttgctcagccgctcatgctactatactctgttatacaaaataactcttctaaataaataaaccaatgctggccctataaaattataggtatggtaagaacagtagtctcagtggtatctgcaaattcctgtattacttcattaattttactcagcagtaccaaagggttttaggaagttgagcaagaagaccccctggtcatttggggacagacatttaacaataaattgagcctgaatcttatagtccccaaacctgacttcctgagtgaccaagcagagatggaatttaaggaacaagcatcttccctgtaagtcccatcattgtgttcaccacaaattacaaatacttatatatgaaatatgcatctagaggcgttaccagtggcaactccatatgggtctgggtctgtagcaactctattcttgccttctttgaggaaagaatttggctgagggacagaaggcagagtgagagactgaggcaagttttagagcaggagtgtaagtttattaaaaagttttagagcaggagcaaaaggaagtaaataaagtacacttggaagaggggcaagcgggtgccttgcgagatccaagtgccccatctgacccttgacttgggtctttaatatattggtatgttccaaggtttgggtttcttctcccctgatttttccttgtggcaggctgtccgcacgcacagtggcctgccagcgtgtcggaggtgctgcatgctcagtgtgtttactgaagttgtgcccatgatcacttggcatttttcccttaccagtcgagtgctgcaagaagaaggtcataaaccagttaaactctgccattttgcctgttactgcacatgcttgagctccacttacccagctcctgcgatctcatcaggaagctgctcatcaccagcttcaggtgtttcccatctattgggagactgcctttccctggcaccagctgcaaccaattattattttagagcaagtttgacatctgcccaaccgtctgctaatggtcacctgacatttctgggagtgatgctctcttgccctgctcatgtatgcctagatacctactctaacagaggtattcagttccgtaaaataatagatttgttgtcattgtcagtagccatcagttatgttttatatttccaagcagtttttaacttcatcacatctcttaagagcaacagccgtatgtaacttttattattaataacccagtgatgttagtataagtaataatctccttaattaccacattccaaaaaaatgtctcggggttgttaatggcttatctaacatctcacagttaatatcacttattctcttgaatgcaagtctgtgcttttgtcaccacattgcagtggggcaggagaaatatctggcatctactaggaacttagttgacatcagctttctctttctaattctctcttccctataattaaattatcttatcatcttgcaactttgtgagatgattgcgtattttaatctccgttttgatgaataagaaagcctttgtaatggatctcaagaagaggaatttaaatccaacaaacaaagagaaaatagtgcactgaatatttgcattgggttttatatgttccaggtcacatttcaaagttgcctttctgttagacttcatagttgtcagggctactaggaaacaagttccttgacggctcttttagaattatttgcactcagaattctttggttctattccagttatttactgttgcacaacaaatctatgtctaaggttagtagcataaaaccacaggattgcattctatatcatagttttcttgggttagaaatttgaataaggagattattgtcttccactggatattaacggagattgcttgatagtgttcagttgcaaacgtgctggtctggaaagcccaagaaggcctcttggtgccttggaaaggataggaccctcgagtagatggtgcctggatgagatggctgggagcctgggttcaccggggactgttgaccaaatgacacatgtggcctttgtgatatgatgatttcaaagtggttggatttcttacatggtatctcagggctcccatagagcgttttccaagagacaggaaacaggtagtgtagcaaaattagtaacaccacttccactatattctactgatcaaatagtcacatgcctgttcagattcagaggaaagaaggaaagaggtatagacacaacctctcagggagaaaaacatcaccaaatttgtggccatctttaatattcacatttcatgtagttctactctatgaggataagcatgctggtatctgatctggtcacagtctgaactgtacagcaaaggatgagggtagtgaaatgtggagtgatgagcattagaagatgctttttgcctctgaggaggatttccctaggcaaaaagtggaaagtagttaaaattgatctttgctgttctgtttgctattaatcttgaggtgaaggttctggcaaacatgttgaataactgaattctgctctagcaaacaacgcccgccatccccatatctactaagtttcctaagaccatgtttcccaaactgctgcaattctgtatcatgttgaccatttttaccatatcagggtccttcttgaagtattgtttaacttctttttctaacttaatttactccattttatttaagttttaagatacatttttcatcactcttataaatggaaagccattatcacttgtcataagtagagatacttctgaaaataaaaccattatctacagcagaggtgagcaaacgtagtggtcattggctaaatccagactttggcttgtttttgcacaatctgcaagcaataaaataaagaagggagggatggattatggacaagaaggagagaaacacagagggagaaaggaaagaggaggaaaggaagttgggaagaagggaaaaatggaggaagaaagaaagaagaatgtagcaaagaccatacatggcctgcgaaagctaaaatatttactgtctgtctcttcacagaaaaagtttgatgaccctttctctagagctatgcttttcttcttgcttgtccttccaatgcaatattatgtgcttgtgtttgctgcctgcttagaaagctgcatttgatgctgtgtggtgaccaacaaatcaatcatgcctcctttccatggtctagagttgttgctgagcagcagctgtccaggcgagggattacaattctgagccatggcatctagtggagccatgagaatggttcttactaatggtacataaacaaaagtgatgggtgtcattttgggttccaggtggttaaatactggttgcatgatccttcacaatctctgtcctctcatgcctttgtctgccagttgaaagatgctttgtttaaggaaataagatattttgcaatttacactatgggatctgatgaacagttgtcagccttaaaaacacatacccattaatttttattgtgtcccattggccataattataccaaaaatacatatgctggcgaagttatagtagcaataaccttattacagggtaactattatgtgggcctgtatgtgacagaaattggtagttaagaaataatactgattttcaggctatgagggcaaaatattgcttgtcaaattcattcagggatattttctgagtcccaaaagtagatgtgagctaagaagtaaattaatcagtttaggatttctattaactgaaattccaaaggtcttaatattaacaaattacaatgattaactcagacataatttcagttgcaggcatgggtaatccagataatggcatgttgaagacatataatagaataaaacccatgcagtactaaaaaataaataaatacataaaagtaggttttatttagtcaatttatcaaggttactatttgttgttgctaattgcagtacttttcatgtgcaaaacactgcagtttcttaaatgtgatgtcaattagcctcacattgaataaaaaaggtaaataagttttatcaagttttcttcctcctctttcccttccttcctttcttttttcctttttcctcaaagaaacaaagataccatacagtcaagtagcttgtccacagttatgtgagcttttctataatccattggtatcttccctaccatttccattttctcctcaagcagtaagccctttaattcatttttagtttatatttctagtttagtgattttttttaacataagcaaatacatatgtggacatctatctatctatccacgtcgccacttcctcacacaaaaggcagcaccctatacatagttctacactggtttttttgcttattttctatttaacgtatatcctggaaattgccatagcaatgtataaagatacctttaagctttcttacaatcacataataatccaatgtgaggatataatatagtttatgtaacttgtcctttttgatatgtatttggaggtgtttctagtcatttgttcttaaaaataatatcaaaggccaggtgtggtggctcacgcctgtaatcccagcactttgggaggccgaggcaggtggatcacctgaggtcaggagttcaagaccagcctgatcaacatggcgaaaccccgtctctactaaaaaaaatacaaaaattagtggagtatggtattgcatgcctgtaatcccaactactaggaggggctgaggcaggagaattgtttgaactcaggaggtggaggttgcaatgagctgagatcgtgccattgcactccagcctgggcaacagagcgagactctatctcgataataataatgataatatcaaaaaactgagaaaatatgacagcaaatgttcttagaaaaacttagaatgtatgataaaataccattgtcatacattctctcatatttggctacatactttggaaaagattctgagatgtaggattactgggtcaaaaagcaaatgcatgtacaattttgttgaaaaaatgccttattacactctctatgatgtttcttctgtatttcattcccaacagtaatggaagaaaatgcctgttttcccacaggctcaccttctttcccaagacaggattttggctgttttcttctgggaataaaatacttctcagtgtgatgctttttgttttgtttttgtttttgttttttttccattttacttgtttgccaatcctattatttatgcaaaaactacacaactttttttaagtttatattcccactaatcatagtagcattatattcttacttgagttttcattgcactgttctcataaggaacttgagtatcttttcatatgtttaaaacttttttcattttttattttaaaatttttgactgacaaattaaaactgcatgtattctaagtatatatgtgatgatttgatatacatatgtaatgtgcagtgattagcacaatcaaattcacacattcactagcagccatgctgcacattagacctccaggacttgttttataactgaaagtttataacctttgaccaacattgtccttttttcttttcttttttttctctttctttttttttttttttttttttcttttgagacggattctcactaagtcgctcaggctggagtccagtggcacgatcttggctcactgcaagctccgcctcccgggttcacgccattctcctgcctcagcttcccgagtagctgggacaacaggctcccgcgaccacgcccagctaatttttttgtatgtttagtagagactgggtttcaccacgttagccagggtggtctcgatctcctgacctcatgatccgcccgcctcggcctcccaaagtgaacattgtcctttttcctactccttagcctctggtaaacaccattctactctctgcttctatgaatttgaacttttaagattccacatgtaagtgagattatacagtatttgtctttttgtgtcaggcttatttcatttaacgtaatatcctccagttcatcaatgttgtcaaaataaaatcggtatcttgaagatacacttcgtgcacccccatgttctttgcaatctcatatttattgcagcattgttaataatagccaagatatagaaacaagattagtgtccactgatggatgaatagctaaacaaaatgtagtctatgtatatacaatggaaaattattcagccatagaaaagaatgaaatcctgccacttgtgacatatttgaagacattttaatgtctttccataaagtgtttgatcacatgttgtgtccatttttctttcagcttgctagttttattcttcaacattctttgaagctttaaatattaggcatactaagtttttatcagtgatagaatttacagtatctgagatataatttacaattaatctaagatccaagtaacaattattacaattattactctaagatccaaaacacaaatatttattgtagttggtcatattttgcttaggtatttttggcatgtaaactattatactttttaaaaacttatgtaaaaaatctattgaccttttccataatgcttttggaaaaggaatatatcatctctaggtaggtgtataaagaaaataaactgttctctttaatacttgaataatttctgcttatttgcatctcttacccattgggtatttgttgtggtatctgtgtgtaagaaatatttacaggctttttaaaacttttatgtttggtgatctagttcctcatatgccatgtatttaaaagttaatcttttcattaatgacttggaaaagcatattttcatttattcatatagcatatctttccttttagtgtttctctcagtttcaaaaatcattcagtctattcattaaccaatatttatttaataaaatttgtaatacagaggcttcataacggcttcaatatatgatggagttggcttaccctaccatcatgaagaggatacctgtggaaccttcctaagaaacagacattgatcttccaaagcaggtgaagctcaaatacagcaagagtcgcacatagctgcatacctggggcatgccacatggaatcatgtgttgcacacacaggaaacaaagggtgtttttaaatgtcagtcccacatcaaaagatgcaaaggcaaatgcttttagtagcagaatttgatttgtaattgagctttttctcccaaacacaattctttttgtttggggtggggaatgaatttcagcaactccatatatgtttgttgaacaaatgaatgaattaaagaatgaactccatgaactaaaggcaggaatttccatgctcaagtttgtaaaatattcttctatacaattatagttagggcaaataacaatacaaaaatatattcaggtatgcctagaccataagaatggctcagactggattgtactggaaaaatgtatggatctgattattgaataaaataaattattacttgtaaaacgaaaaattggaaaagagccttagcagttgaatataaaatattaaagagtattaaaaatgacataggcattcattcacttgaccagtgttcgttttatgcctactacatagctagcaaaaatctatgatgaattactaaagtgaacagtgtttgtacacttaagataaagcatttagtaaccacgaaactcctgcttgaagtccttaaaaccatgaaatgtcaaaccaaacccagattctcagttgacagattgttgtattaatccattcaccaaaatgcaaatattaatagagaatgcatttttattttatcaatacatgctttaatgttgtctgaaatgtttggggaataaagaagagaagtaatggctttaaaagagttaagttcatgtttacccaggtggacaatcacagtctaaatgctgattaaaattttaggtcaacttggagggaaagaacctgagatcactcacagaattctgctcaagtgccttcctactttccgtcaataacgtcaattgatgtagagaggattttttacaaatataacttatgaacaatttaaatctggaagagcaagcaattatggtgaattctagaatcaatgctcagaatcaaaaggctgaaatgacacatcaaagctagcaaaatgaaatcaactggaatctaacaggttgacattccatgttttaaaaacataattataaaggtaattgtgcaagaagtcatggaataccaaagctcagaaacaaaagtttaaacaaaactttaacttgagttgacattaaaatttaaagtataagtaatatcctaagactggcattcataattgtgcagatattttccagtattacaatggatagtttctgccaaataactcatctaacagacagtcatgcatatcggtatctatactttcagatacacattttttcagcaaaccaggtactgtaaagtataaggccctataatgttcttttcattatctaaccctctaacactttgaagcacattaattctttttatctccctgctttttgtttccctctcattctgacttacattggttagccaaaggagcagcagagtattgcagtctgagattaaagtgaacctgctttccttttcttttttttttttcccccatatggtatttgttttctttattattattattattattattattattattatactttaagttctagggtacatgtgcacaacgtgcaggttagttacatatgtatacatgtgccatgttggtgtgccgcacctgttacctcgtcatttacattaggtatatctcctaatgctatccctcccccttacccccacctcacgacaggctccagtgtttgatgttccccaccctgtgtccaagtgttctcattgttcaagtcccacctatgagtgagaacatgcggtgtttggttttctgtccttgcgatagtttgctgagaatgatggtttccagcttcatccatgtccctacaaaggacatgaactcatccttttttatagctgcgtagtattccatggtgtatatgtgccacattttcttaatccagtctatcattgatggacatttgggttggttccaagtctttgctattgcaaatagtgccacaataaacatacgtgtgaatgtgtctttatagcagcatgatttacagtcctttgggtatatacccagtaatgggatggttgggtcaaatggtatttctagttctagatccttgaggaatcgccacactgtcttccgcaatggttgaattagtttaaagtcccaccagcagtgtaaaagtgttcctatttctccacatcctctccagcacctgttgtttcctgactttttaatgatcgccattctaactggtgtgagatggtatctcattgtggttttgatttgcatttctctgatggccagtgatgatgagtattgtttcatgtgtctgttggctgcataaatgtcttcttttgagaattgtctgttcatatcctttgcccacttcttgatggggttgattttttcttgtttaagttctttgtagattctggatattagccctttgtcagatgggtggattgtaaaaattttctcccattctgtaggttgcctgttcactctgatggtagtttcttttgctgtgcaaaagctctttagtttaattagatcccatttgtcaattctggcttttgttgtcattgcttttggtgttttagtcatgaagtccttgcctatgcctatgtcctgaatggtactgcctaggttttcttctagagtttttatggttttaggtctaacatataagtgtttaatccatcttgaattaatttttgtaaggtgtaagggagggatccagtttcagctgtctacatatggctagccagttttcccagcaccatttattaaatagggaattctttcctcatttcttgtttttgtcaggtttttcaaagatcagatggttgtagatgtgtggtattatttctgcagactctgttctgttgcattggtctatatctctgttttggtaccagtaccgtgctgttttggttactgtagccttgtagtatagtttgaagtcaggtagtgtgatgcctccagctttgttcttttggcttaggattgtcttggcaatgtggactcttttttggttccatatgaactttaaagtagttttttccaattctgtgaagaaagtcattggtagcttgatggggatggcattgaatctataaattatcttgggcagtatggccattttcacgatattaattcttcctatccatgagcatagaacattcttccatttgtttgtgttctgttttattttgttgagcagtggtttgtagttctccttgaagaggtccttcacatcccttgtaagttggattcctatcctatcctattttattctctttgaagcaattgtgaatgggagttcactcatgatttggctctctgtttgtctgttattgctttccttttcattcctgacaggcaaggtgagcgccctgaacaacacagctcccctgatcttttccccctacctactaaagggggttgtcctcctaaaggggcactgaaaaatcactgacatgaggcagattgattgataggagaaaagatgtacaaatttatttaatgtgtacacgtgagagccttcagaataaagacccaagctaacaataagatacagaagcttttatattaatatcatcttagttgatagaaataatgtggactcagagcatgccccacaacaggttttagttgtaaggcaggttataagagagagaaaggaagaggcttgactggcaagggtggtcttgttaggtaaatgaagcttccctcagagaaaatagatggtaaatgtttccttttagacttttaaaggtgtcagcctctcaatctctcttagttctaggaaaggcatacaaaaggccttagtaagctgagcgtggtggctcatgcctgtaatcctagcactttgggaggccaaggcctagcactttgatcatgaggtcaagagatcaagaccatcctggccaacatggtgaaaccccgtctctgctaaaaaaaaacaaaaaaaacaaaaaaaaaaacaaaaattagctgggcgtggtggcttgtgcctgtagtcccagctactagcgaggctgaggccagagaatcgcttgaacccaggaggcagaggttgcagtgagtcgagattgtgccactgcactccagcctggtgacagagtgacactcggtctcaaaaacaaaaaaagaaagaaagaaaaaagaaagaaaggaaaaaaactgaaaagtcctgggtatattaatggaaattctctacagaggcaaaatttttccccaaaaaagatacctttgcaaggccacttctgtttgctggcactgcagcaggcattttataatatgtgaaataaatatatttttggataaaatatatttatgtcttttggtacctactttgaaacttaaaacaatttttacacattaaaagccaagctgattgctttggtagaatttgtgttaagggtcgttagttagagatagccaaaaaagtagaaagataaattggtatatacagaaaagaacaaatttaaacatattgtttaaatcttctttagtctgttagtcatgaaaatatatcagttcagttaaacaattgtgtctcattccaagaggtggcattgcagatgggctttgcctttacgtgtgatgcaggcaaccagctctctaataaagcatttctatggaaacagaaggaaaacaaaggttgatgcatggcacggtgcctctatagactagcttttctagagtttctagggcatcctcagattgcaagggcaacctgacagattcttctggattgtaatttggaccaagagttcaagtgaactttctgagaaatccacacatcagcagggaggcatgaaggttgttcatatataagttgctattatttttttactgacgtttaagttgtctagcttcaatttgcagggctttaagaaaagcacagttttaatttctaataattccaagccagaaaaatggaagaaaaaatgggaaataaaaaaatgttagtttggagacttgtaacaagtaaagaattcagaattcagactaaaatgtagagaaaaaatgaaaactcaaaactaatggacaaggctagaatctaataataggtatatgactgtctcttttgaaacataatttttctctctctattcccccattttttaccaaagacaaatcatagcaggaccaatttatttgcaacacaagttttagtcttattatacttggcttgattaattgcttaaagttcaacaggaatcattgttcatataggcttttagacgttggctttgctggaacttttttcataaggaatctcagattggacttttaaaaacctttcaagcccagccaataacttacctctgcctgcagatacctattatgaagtgggtaaattcctctcttcttgaagtcctcaaaaaacttgagattcttaggcctgtcagaaagtggcattctttacttaccataggtcaggaaccctgcaaagtaaccatgtagacaagagaccagtcattccaaggggctattattggctctataaaatcaatcttaattcctcaaagcattctggtcatatctaaaggtatgcccttccagctgaagccatgctaaattaaccactatctctatttatgtcctgttaaaaatgaaacagattcttactcaacttacacaaataactatattgccatgaattaagaatacttacaaataatttccaaattctggagaaatcagacagaaagaaatatgcttctaagtttgtttacaagagtatatttactcagttgttaaaagctataaatagctcaaaagaaaaaagttttcttgactctgaaaaacaaaacataaagaatcagcaatgttttaaacaaaaaaagtcataaaaaattatttcagtatctaatagtccagtcccatgcaattaactcctgttcttcccgatattacactaacaatcctcattaacactttagctctccagtgaaagttctggaagttttttctctagtccaatggcacaatctccaaaattaacagaaacctgctttcaagcatgcctatccaggtcctttctatgaactccccataagaagcaagttttgtactctagctgatgataaaccactttttgaggagaatcaaagcaaaacaactgtggatgacaaaagtcttagcacagccatggtgaaagacacaattgacaaggaaatttggttacttctgtggcatacaaaaatttatcataatagatataattattactgacaacatactgagacatatcagaattatagaaatcccatactattttggaacacacactaataacacatttatataaatataacccaaataaagttaaacattattttatatttcacaatgctttctatatgattttaacataccaaataagctgaatatgtctttcaggggacctaatatctaaaaagctaatgaggtcaaaaagacagaatttgaaatttgattttggaaagtttgtcaaatatgtaagattttaaacatctgatgtcaaaaattaggcaaatattttagaaagcaaaaacatttatgctttgagaggagactcagtttcttaaacaataaggcataataaagatacgaagacaactgaatctgtctttctcttccctttttttgcagtttactcaacaggttaaaaaaaatctgttactatctcttactattaactgaaaactttatccaaaagagaaaacaaaattttacttttcaatagcatattattaatgctaaagcttatttcaatgaaatcttatgaacaaactcatccaatctcaaacagtttgaccataaagtaagatttttatagacccttttataaaccttaataattttctattaaagagcagatcaatgttccaagaaaaccattactgcaacacaaaggccctgattctggccctgtgtcagtgtgcttttgatattaatgtttaatttatagaaaaaatgaaataattccctttaaattttagccaacttgatcacaaacaaaattccttttttaacattaatctgccataaaccttctataacttacttaaaccttcagtttttttctaatattttactttaggacaaatatttcctttcctccccaattttctatatccgtttagttttatccatcatttttttctttaatttaaaacaattcttataaacctttaaatgagtcagaattactttttctttaacaaaaaccacatttccatgttttttataacctttttacacgtcctactttattatatgctttgtatatagaattgtttcttttatatctagtagttttaattttatttattacagtgttgactgtaactcttgtttttagtggaaaacctaggaggtaagcaattttaattatgtattagattcagagcccagaacaaaggacagagctgcagataatgccttaccctttcctgcatagccaggaggcatagctaggccaagaagaactcatgtctatttgtttagagcctagaatctaatagttgtaaaacaggcaagtcaaatatttgtcaaaaatatcacacataaatatcacaatttatgaccttaaaacacctagcaaaggcagtatctgacctgcctgtgtaattcagactgaatttctaaattaaagtctgaagatgtttccattttatcttaccagtaactttcaaaaactcttaatttaccaaagattagtcacatgaactatgaaactatgtgaggtaaaatttttatttttctgtttaaatatttgatttaagtattttttttccttaagacaagtaattagagctcttttacatattttagtaatgaaacatcatatgtgcttataaatgtgtataaacacacagacatacaggcagagaaacaaatcttcacttgtcatatttcaaagtttctctccagtattttagactatcagtctcttgattacctgttttcttctctaagcaattattagctaggcaaccccaaatgtgcaattctaaagggacagctcttgtaaaacaaagtagaaaatttatatcttagagtacaaaggtaaaacatttggcctaaatattgtatcatcatctgctcaaaccacgggaaaaaattatgtgagtaaaattcagttaagatgaccagagaaagcaccttaaacaaagagatgacttgtaaattttaaacaatggtaaacacttttaatgtacacaggtaggcaccctttcaaatggagatttccttaaatatgtaaatttcttttacaaaagagtgtcaggatagctagctaaatgctagaaagttgtattttggctattttacttaactcgtttcataattagatgactagcttcagagtggagccccttggtgaatatgggaagaaaagcatacagtttttagggcttactatttaactacatgagaagcaggcacagctggaagtaaaacgcatatccctcagaatcaaggatcccatttgcacattgaatcctgggtcccccaaaagagacaaacacaacaggaggagacagtgcaatgtttccacagtatacttcactgtgaggacattccctggaggctgctaggcaacccaacaccagtcagcacactctataatcagcccattccctagacattaaacacaccaaggtcaagttttttcacaatacaaagtaatttctcatgtccttcaaagccaaagagatcaggtaaggcaatgcaaaagagactgaatatgacaaagaggaaagaagaataaggtggattaaaaataaataagagaacaatttttaagaaaggaagcaaacgtaagtaccatgtacataatttagaaaaaagttttagccaactaaaaatattccgcaaaacaggatccaaaaagagaaaaaacataaaggtcatatatacatatatatacacacacatttatatacattatatattaatatatattttatatgcattatatatatttcatttacatatataaataaaatgtgtgtgtgtagcttagatatcagcttttaattaagcagatttctaactgtagtgctcactcctcaaaaataaaaaaactttcaaaatcttattactggatttcagctgggacaaatagcttgtcttggcttttgaactcctttaccaaaggtctaaagcagtcctcataagatctagaaatatcaaatcaaaagagactaagtgattccttcatcagaccaactcttctgtcaatggttgagagaaagtgttactctcaaactatgattgtaaagttgtctatttctcccttgaaatctttcagatttttgaaaattctaaacttcagttattaggtatataaacatgtatgattgttgtgacttcctctcccttttatcattatgaaatatgtctctatgtttggtaatactaattattttgaagtctattttatttgatattattattgctacttcagccttctgacacttgtagatctttttccatccttttactctcaatttctctgtgtctttgtatttaaatctttcccttttggatagcatatattggggtcttatgggccttttttttaatatttgaacataatctttgccttttaacttgagtgcttagcccataaacatttactataagatacattcagatttagttctactattttattactggtttctatgatggtcatcttttattttctggtccttatgttggccatctttcattttttggtcctctgatctcccttccctgccttcttcttaattacttgaatatatttttagaattcaattatttctttactagctttttacctatacctctttgtatcattgttaagtggctgttctatggcttacaatttatatcctttataatgaacaatatataacagtatacttcaatttttgtagcattttgtgtaaaatatagaaaacttgcaatcatataacaggtcactatcctgtaattacagttgccatctgaattaatatacacacagattaaaaatccataaataattttataatatttgctttaaagggtaaattatattttgaagaaatttttaaaatagggcttttttatatttactcataatttaacatttttaatgcggtttgtttatgatgaaagattcaagcttttcatctggtataatttcctagtttctcttcagcctgaagagcttttttttttttcattaataacatgttttttggagtgtaggtttgacagaaataaatttccttagtttttcatttaaatatgtatttattcgatattaatttttgaaacacgtctcactcattttaaattatgagatgagaactttatttatttattttttacctctgtaaaggtttctttttcttccctgctctcttttgttcttcatgggtttctgatgggaagtctgtttttattccaattattacacctctaaaatcatatgttattttcactgagtagtttaaaattttctcatgcttttgactttgaacattttgagtatgattatctacaaaatatattctgaatttgtcttatttggcatttgctcaactattaaatttaacatcttgttcatttaccaaaaatggtagttatagtcattatttcttcaagcagctcttctgctccattttctttctctccccttctgggactcaattacctatatgttaaaacttttgacattgtctcatagacttcttaggccctgttaggttggttagaatttttaaaatctctctcatcttttggtttagtgaaatttattgacagattttcaagttcactggccattttctctttcatctcctttctcttattaagcttactcagtgattttatttcagatgtttatttatttcagttctaacatttcactttcttttttatattgtctgtatctttgctaagattttatactctaccttgaagaacaaagttataagaggtgctttactagcctcatacgataattctagcctctgcaccatcctgattggcatctgttcattattaatacctcgatattgggtcacatttgcagcctttctatattgagtaattttgaattgcatcctggatatcgtgagtgttagttatgctgaatatattctggattctgttctattttacctccaacagattattgaaggtgtttattttggcaggcaatttacttactgtcacacatatagtgcattgtagctcacatctcacttttttttgtaatttttagttgtaagttgctttaattttgcccaccatcctccattcaccttatgaatggtcccagtggtcaaccaggaacttaccttgagtttatgcactgaattaagggttcctttttcctggtctctcctttctgtctttgactctttgggagccattgttaccccagagcgccgtcacctgttttttttgtttgtttgtttgtttttgtttttttgatgagaagtcatttttaacctatctccactgcagcagcagctatcttaaggataaatcaccaataaaatagggattttacgctatgctgccccaagttttgattcccctttagaaactccctgcttgcttcatcctccaaagccctcagctagttgtgtttttgattttatccagcatttagttatttgtgtaaggattgtttttttaagagcttactcttcaatttcaaacacccaaacttcctgttcaataatttttgaaaacctaagatgataatgtaataactttctctcagatgaataagtattttaatagattttctaaaatccagtaaaacatactttggaaaaggacaataaaagtttttcttaaaatttttatttacatatcaacttaattaaacgtgttagctgatttccatgtatatatggaagatcagagaactaaattcttcaggtaatctatttttgcacatctttgggaaaaagatttctgtttgattgcctctaaagcgtagctcattcacatttaattatcttaagaataggccacttgtaacattaatccacaaagctgaatttataatttgtaagagatggcacctttgaagttgacatttcttttatatcaatgagattgcagctgcagatgaagtgcaaatggcaaattatgcaaaataaaataatcacgaggggaaacttcagttgaatatttctgtttgattaataatctatcagcagataccatctaatttaaatttgcacaaaagcataactgctgttgaaaaattgctgctgtttaacggggacacaaattcacatttctttccctcctcctctttgtgtagccaacgattgcagttacttggttttgaattgggctttttagagttaatgccttgaaaatagaaaaataataaaaagctttccttcatcctatttatgcctattcacctgcttatcatcttcaagtcttttctaggtcctatgagactagaatcattattcagttttgcccagttacctacttcttaaaagagaaatgtcattcagattctttaaactatagcggatagtcattgttctggtttgtcaaagaccaccttaaagtggtgactagaattgaaaagagaatttatttaagtaagcgtgatgaatctaacttttctcattatctggactataaaatgtcattaaggtttcctaagattcaattaggtttctttgttttttaaggggttggtttctttatgcgttttgtttctgtagcaaccctatcactcttgtaacagcacaacacaaacaccagttacccaaatataaaaacataattaaaagctatgcctttttcacatcagataatgccaagtctgggatatattacctgattctgtaacgtagataaataccttaaatgcattgttattaaaattgaccacagtgataaaatttgaccacttgacagaaattctaccctattaaagactaatctttagagagaaaagaaaaaaaatattacttgggttaatgagcttggatgtggatttagaaggtctaattcccaactagttgaataacaataattgtatcactttctttttttaaatggagacggagtctttctctgttgccggctggagtgcagtggcacgacctcagctcactgcaatctccgcctcccgggttcaagcgattcccctgcctcagcctcccaggtagctggtattgcaggtacgcacaaccatgcctggctattttttttttttttttgtactttaatagagacggggtttcaccatattagccaagatggtctcaatcttctgaccttgtgatccgcctgccttggcctcccaaagtgctgggattacaggtgtgagccaccgcgcccggccaattgtgtaactttcaacaactcatttgacctctaaaatttctgtttctttaattgtaaaactagatttttaaattaaatcacctgtatcttctcttttattctaaaaatggacattttcatgaataaaaccccacattgtaagcagaaacttaacagtctctaagtaaaattctgtttgtcaataggtctgagtactccaggcaatgatgactctcatgatcaccttcacctggatgtgtttccagagatcaaagaactatcagacacagtctctgtcctgaagaatctgattatctttatacaatgacagagttatacattgagaaacataatgaatggtttaaaaaaatgctcgaacacatttccaaagtaaatgctcatttttagcacagaatcttttaaagaccttacaatcaaatttatatcacattagtccatttcaacgccatattttctatttatcgttacttctgtgtcctataaaggaaatgatatcattcaacattcaaaagcatcttttaaaaaaattatttttttagtctttctatttgctctttggagtcatataaatttctttattttttcattcttctctttcatgtaaagttgctgattttataatactaagatttcataaaagaaaaagaccttcctctcagacaaatgttctatgtgaggaaaaaaatacacctgtttgcaaggtgacatttctttgagggctcactcatggcacagcctggggatacacagaccacgggccaacatctgtggggaactcagagctttgctaattgcattcatcatattttctggggattcacttagtgctctgaaaaagccagataattactggttatttaaaaaattactttgaaagaaatacacataaagcatatccctctcttaattctttgaaataatttccaaaaattataattatttttaaataagttaaaagtaaatttaagggaactgaaaattattaaggttcttgattcttgatgcttattggcatgttaccttcggaaagttggtgcatttgccattctacctgacgttctacctgacatgtttaagggtcatagttctctttatccttgtcaacatgctgaatgttatcatttaaaaaataaataaaactgtgtgtgtgtgtgtgtgtgtgtgtgtgtgtgtgtgtgtgtgtgtgtatagtcatctgcaagttgaatgtgttctttggagaaaaaaaggtctatgtttgagtcaaaaattccatcatcaagacacagcctgtggtctcatattttcttcagttggtgacaaggatctgtgaattgtgacttggaacaggtgggcgcacacccaccccccgccccgccacccccccaaaaagaaacaaaacccaactctagtcttcatgacagtggcagtgaccaggaaaataggacagatctgttttctcagctttctctgcactccccagtgtctagagaggaaggtaagcaagggtgtaagctcaggccctggtgtaacgtttgggcataacagagctgggctggaacttggcctctccactactgtgtgttttcgttgttgttgtttttttttgttttttttttttttggatttcttgacagctctaaccacgtaaacctaatagcagagaaaaggagtaagtgtcagccctgccatgtacaacgctgacatattttaaaagcaaacctttgttcaaaataaatcttaaccattttagagcactgctatttcttcactggaatttggatcagagaacaaatccagtccactgacaagatgtgagagaaacacaagagtttctttattctgtaagataaaatatttatgagatgatttttatcagaaggcacttattatgtagcaatctttacagactctatgcttgctgcagagttatctatgcaaaatttaaactaaaggaaacctaggtgtttacatcttaagaaagacatacatttcaaccaacagaacatgtgttatagagttgtgttttataaaggtagagtggtaaacataccttaggctaaaggaagaaaaatgatagggatatgctgcaagctgaataaacctcccttctagctgtttttttttttttttttttttttttttaagatggtagcttttgagacagtgctatctttcaggatattcagattccctttcaaacaaatgaatattctgtgccctgattgcatgttttgttaagttgggtgatgacagtggattcttagggttgtcctcctgagagagtagccccaactctattttcggagtttttctattctctagtctttgtatatgccacagacatttggtctctgagtcctcagtcttataacaatagatcttaagctttgttatctaaaaaactatccagcttctgatttaaaaccaagctgcctaactgtaattctcatatctgttatttcttctaagatctcagaggaatgctctcaacctggactattttagctcattcaatagaacataacagcagtctctgagcctgagctggttagccaccatagttctgttctgtcagggtaattgctatcatgattcacaactagtgtctcttttcttcaagaaactgtcactcagatttaccctaccttcttcacctaaatccaattctttagatcataacctaaatctaagcctttttcatttcacaaccctacatctgcaaggttcttttaattattctctgactgtctttcagttttctaacatcgacagtatagccttgcatacttttcatgaggtcatttgctttttgaaaacataagtagccacctccttcttaccatactgcaaaaactcctgtgtaagactgtttaggtcatttaaagtctgcacatctccaatttcttctcttgtacttaccacaagaatttaagaaaacattaattaccgaatgatttatgatattttcagttgcattttactctaatttgatatatctttataagccattgctaatttgttataacttactgcataaagagagtttgatagagggtttcatgatctctcaacaaaatacgaagataggtagatgatagtaaagttacagagaaaacaatctccaatattcacctgctctataggactaggtcatggaatacctttacaaaataaagaaatttggagattgtcttttttggcaaataatgattaacatgcatttttttggatagaatcaatttttgggatgtcacaagggttatataatttaatgctgataagaaacataatagtatcactgtttctctcattttgaaaatgagaagactgtgagctagagagaatacatatatcataatttttctaagatgaacaaaaagatcaaaattttaaactcttatcaccccaggctatctctgtaaatgatctttttaatttattacctgcttttggtatatatttccccagttttgtatgatttgcagctttttaaaatattctgattctttccattctaagcaaagaagaagtgcatttttctccagaatgtaagggaagtactcggcatttgatcttaatttcgctttttttacagtgtagaatgaactacagataagaggggtggaaagaaagaaaagggagagaaagccaacatgagcaaatttctattaattgtcagatcatgacacattccagccaagaatgttcctatcttcttatcaacaaaagtaaaatttactctctctctctcttttttttctcttgtaaaaatagaaacttctgacttgccttttaagctcaaaatcaaacatttctggagcacctagtatgtgagaggatcattttctctatcaaacatcttcccaacaatattatgaatgcaaagtattatgcagaattgtcaaataaactttaacaagttatgtatctgatccagattcacaaagaaatccaaactccaagttatcatgacttcaaacttctatgcctttgatattttatgtatcactagatgatattgtgtctttcaaattcctaatgtagaattgttggtaaaatgaagctctctagccaaatttaaattgacctacgagttaataaaaatgtgctaatttctaatgcaaaatcttatttagcatttttaataactaaaacattcctattgatatttgctcacaaaattattttattgtctaaaaataaattgctcagtaatgtttgtttttaagcattgataataatttgaggtggagtcttaattcttgagagaaaaacctgttcttaaaatcctgcagggcaaactcaagcattagacctttatttctcaatatgttctttcgctttttttaaatgaaattgccaaaaaaagaatagattcaaatttaaactaaaagtctagaagctaaaaccaagctaaacaaaataacactacattaaaaatataagtagatgaaaatgtgctatattttcttgtccacttcatcctgtgtaacttgtcactgagcacccattaatttcttttaaattgtttccttcactttcctcttgagagctggagtgttgaatctagcagcagatcacagctacttataaacacttggctgaaggactctcaaattctctgcaagattttgagtaaagtgaacctaggaattctgaagggacaccctttagtcagtaaggaaagagcgttcatctattccttagacttgttgctgctatcacagaagtcaaagttaaaaacacagggtatgaataccagtactaatttcctggactgattatcaaggagctgtcctctttcatggtcagaggctaatataagcactcctacaacaaaagcaggaagctttgtttctattttcttacccataacaatctttgtcctttattgatatgggagataaaaagtggtgacaatatcagacaaaaggaaagaaaagaatgcgagctttcatttttcctctcctgccttgatgagaagcagtcaaatgcaaccaaatgcccttggccatgtgaggttgggatagctcttaattagtctgcaactccaaactatcaaaaggtagggaaggcaaggatcctaggaagaaaaaccaaatactcacagacaattaaaaactaaagcctaatagttgattaatgaaatgatgtcagcctgcatgaagtgcccttatgactttgtacgaatcccttacgctgtcttaataacttggatactgatgtcaaagaaggtgtgcttatcatttttggcaaaggcataactatgagagacagagttaatatatttgaaaaaataatgcaaatttaattcaaacatttaataataatataagaaattagatgttttctcacaagataaatttaacatagatagggataaaagcccacatttagtaaaagggaacatatgaaagcacacatatttacacagatatatagggagagatgctacttaacaactgtttatgtacaaaaaatacatgagcgttttagttatttttagcacaacacgagtcaatagcattatgtggctactgaaagcattctcctataatttcagttagcacttttagaaattgtgctaaagtaaaacaagaaaattgttctattgcattctttgtcatatcctttagcatttattataactcagtatcattaattcattttttacttatttaatgtgaatctgttccattagattgtatgcttcatatcacacttgttttattcactaatccttgttcaacctatgcctactacagtacatggtccaagatgtatgtccttggtgtcttatatatagtatatgaggaaaatttggtggggtaatgtaaaggaagtagacgcctgggtggaaacgacatacattatatcccaggaaacaggcccagaatcaatatgtagaaaccagagaatgattaacttaaagtcttaaagattaattttagaatacttagaatatcatatgttgtaactattctaaagtttataagtagtccaaaatggagtagactagacttctgtttaaacatggtggaataataatacttttctttctatggcctaagagacaccaagtcagctgagggcacaagcactaacaaaacaggaagacagtgatgattaaatccttattctggctgggcgcaatggctcctgcctgtaatctgagcactttgagaggcagaggcgggcagatcacttgaggtcaggagtttaagagcagtctggccaacatggtaaaaccccatctctactaaaaatacaaaaatattagacaggcatggtggtgtgggcctataatcccagctattcaggaggcggaggcgtgagaattgcttgtatctgggaagcagaagctgtagtgagccaagattgcattgctatactccaccctgggcaacagaacaagacaccgtctcaaacaacaacaataataacaataacaacaaaaaacagacaaaaaaaataccctgcctgccaaacgtactctgtcatgaagaaaattggaaggcttttatccaaaagtgggacaaaccaagagaaaagatgcgacattgccatgtagttgttccaaataaaatggggacaattatttggaacaactaatgttgttctggtcactctacagcaaggatcatcattcctcaaactatgtgataagaagttccaacaagcctttagcatctctttcttaaatattaatggatattcagtgatgatcagatatgtgagcagagcttctaacatgaaaggaacaatagtaagaaaactaaagaaatagaacatgaaagtggggagtataagaagaaaaatattaatatccaaaatgaaattttaaaaattcttttgttaatgacaagatgatatcaaaaggaacatagaatccatataaattatgttagacaaagttgaagacattgaaaaagaacaagaaaacttaggcatataatataaaaggagaaatataaaacaaataaaagatcaattcataaagatcaagacaaattccaggaagaaagaaccgagaaaatgggaaagaaacaatctatgaacaatagatggagaaaaagaaaatgatttctgctagggcacatcattatgaaattcccaaatgtagaaaataaactattccaaagaagaaacagcagatttgaaaacagaggatggaatctcagaaagggtcttcataatggcagtattagacattagaagacattaaataagcatcttcaaaatactgaggcaaaataattagcaagctagtgatccatatctggccagcagagcttattagaatgaagacatcttcagacacacaagatctcaaaacaataactttctcaggaaactactagacaatatgttgcgggaaaaaaaaggatgaaaatcacaaagaaagttgatatgagattgatgtctaggaatcagaggatccatcacaggagagatgaaaaaagagtcatcaggaagatagtgaagggatattccaggattccattttttagcagtcccagagagtaactaacccagataaaaagaagagaatcgtaagctctcacagtgaagtgttcaagctaaaaataagtgtaaataaataaataaatacctctcttctcccccaccaaaaacaaaaaaaacaaaaaaaccctgctaaaataccagaccctactgtgacatttccattctactagtagagtttggggataaattcgttgtcattacagagaatagtaagaaaaaatttcaggaagaatgagtcattaaccttagtgaaaccaatattgtatcaagtaaaacaatgtaattaatggctcagctgtgaataatatttataaggtcatgaatagtgaaacgactgaaaactgattaattttaaaaactgaaatatgccatattgaatggttggaatgaatagttaagagctacaccatcatttccattaatcagaaattaatacagaatatctaaaattacaaaatcaagaaatgatgtacaacagttatcaattgcagaatattcaaacgttttgtagcttaaaacattaagtatttattatcttacatagtttctgtggtcaaaaacatggtactggcttcagtgtgtgaactgagtctctcataaggttaaggttaggatgccagccaagcctgcagtcagtaaggcttgactggtactcaaggatctgtttacaaagtgactcagtcacatggatggcaagcacatactactgttggcatgaggcctcagttcccctcacccccccatggacctcacctgcataagactcaagatatggcggctgcatttccccagagtaaatgattcaagaaagggcctgtaatagggaaatgtcttctatgactagtcttagagggtacaagttgttatattcacagtatactattagttactgagatcaaccctattcatcatgggagaggacttcatgtgggtaacttaccatggggaacagaggatgatatgggccagcttgaaggctatgtaccacaagcagtatgagtgtgtgtgtgtgtgtgtgtgtgttttcaacatgaagtgaagtttaaaacgatttgcattacaaacataaaagagctacatgggcagagatcctagtacttttaaaagaactgttttataattatccatgtgaatgaaactacaggtctgggaccttcttttcctgaaatgcttgtatatattgggcagcttaatttgtttactttgttattattgtaagagatcttgagtaacctgacaataagctatatgtgctctttaaattctatatatctgctctccagtaccactaccttggtgcaggcagaagtgagtacttggaattggctttttgtattattattttgaaaagaaagaagaagaaaatcagtaaacaatagtgtcctaaatgaatatctttagaaataacccttcttagtagaccattgatattcttcggcatttcaggaaattaatccacccacttgataatggttgaaaattggtatcttaagacacagttgtttctcccaacatatcgatattatatcagactgatgtatcttgcattctcccagtaaaaaggaaatagaattttaataaaagccagattgtgcaactaatactctggaattgtagtgcattttttaaaatcttcatgcaggaaatgaaagagaaaaaaagaatccagatcctaacttttcagtagaagagtgaaatgtaaaatgattttagaaaatagattattttcaaatttgtattcttcacttttgaagaagagcgtattttcctcctggatacataatttggaaacatatttcaaaaaccgaatcttaatctatgcaatgaacatatcaaaaagtaaattactatcttcaagggaatgaaatatcatattagagaagcacactctagcaccacagtaattatggctttgccaacatttctgtgcaaagtctgattctgaaacagttttttcttaccccacacagccttgtttatgtaagaatttagtgtttaccccaaccttcaaatacaagttgacctattgttttacttctttaagtgaaactttttgggactatatgactttctaacttcctccagaaatatgtatggttctggatttcctccgtgcttcatctactgtagcttacagaagagaatgttatagaattattgcattttagaatcgaactttgaagcatgttactgaagccatatcatgatgggggagcagtccagaaatatttttaaagcactagtcttggagtcagaagctctgtgttagcctacctacttattagtagggttgccttgatgaagtcacttgattttctgaaatatttctctctctctctctcaaaaatctgtaaaatggaagcaacaaactcaatggcttttaagatctttgtaacctccagtgttactcaagtttgaatagagagagaaggtgagaaacaaatctagaatacacatctcctaactcccagtttggcatattcacaaatgttagatttatgatgattagtgagaaaatataactattccaaatacatttctaggtatgtgagatatattacaatatggaaggaaaatgataccaaattgtggctcttctctatggccctcatcagggaactattctgaaataataggacatgtgtctaaccaaatccatatttttatatgctcatcagcttctaactatgtacttgacttgatctattcttaatgtcaccaaattaacatcttgaggaagcatgaaattttccaaaaagaatctatgagcatttggtggctatttgccagaaatatttctcctggacaaaagatggaaagccattctggaaagcaagagtgttttattagaatacagcagtgctttagtttaatgtgatcattacccttgtaagtttctaatcaactatttgcaggatggttttacaaatatggtttgactaacctcaagccttattttttgcatgcgaaatctactaaaaaatgcaacattatcattattgcatttacatatttcttccacatgtataacaaagtagaatgtatctccctcgttcttaccaaaaacctctaatatagtgacgtgttctgccaaaatgtaataaatgagaaagcatatgctttgcaggcagacatactgggtatttggaatctcatttctgcacttcttagctattatgttcctgggcaagatatttaatgtctctgagcctcagttccttcctctgtgaaatgagactaataatactgctctcataaagctgtattaatatatattctaactatatatgtgaaattacataaaattatgaaatagagagagtggtatatttagctccgttagatgcattaaaatgctaaacatctgtatcttttttttttttaaccagttttctttcaatcacgataaagtcatgacaactggtaactttaggaataatcttaccactaggcagggttgataaatcaattgtataaaatggtacataaatcaaagcctatgtttctctttttaatgtgtgtagccacaactactacatgaccttcatgctttactgctgagagaatacatatttagacaaaagctcaaggagttgcattctactacataacatgcagtggtttgtttctgtgactcgctgtggaagtgatttctaggagcgccagatgcttggatgctatttttatatagatagaaagggaatcccttcatttattggatgttcttggcatggtattgtgtgatttggtgcttgaccaggtgggagtctcttatttatgaagttcagaaaattccagtgcttagccaagtctctactgaatgcccaggatatacttgaaggttaacagtggcataaagtattagtgtttcctgatttttatatgtggatagaatatcttttggctcttggtttatacagattcttgcattattctctcatgagctcagttcttggccttaatgcccttgagttctttagggctacttcctccagcctttttgtctgacatcactactgcctctccacgatgtaaaatctgcactgtgattcaaagagatcccctgcatatagcagagtcattcttccaatggtttcctctttctttttcatttcaattcccacaagcctccatcttcagcaagtctgttgctgacaggttgaacaaatactgctaagatatatttattctctgagaccctttttcacttagagtaaatatgttactgtctcagttcatgttccagcaaaacgcagactctaaggtatggatttcagtacaaagagattacttggcaggtgatcttaagaaataccaatgagaaagtgggataaggaagaaaaggtacaataaaggatcctttgggaagcctgctagcactgtgggcaactgagattgaatcctttggggagcactggagaatacttaactgagagtgactcccatgcctctccacaggagggaaaatagtatactcagtccctgatttaaagctgatcccaaaggcattaattaccaataattctgtagactgctgatggagagatccaaaaaagctttggggcagagcaacacagctgttcagctggaattcagggcatgcactgaaatggtaagagacaatgggataggagcagataaccaaagtgtctaccataatcacctttaaaacatgctttatgcaattatagaattggaaattattttagagaccagctctcagcttatgagtcacaacaaggttattgataatatcgtaggtgggataattctttattgggcagagttagctccgtacattgcaggatctaccactaagcaccagtcagacacccagttattttgactgcacaaataaccatttatattttcaagtgcccctctgttggtcaacattttctctgagcaccacagttttataggggaaggaattttttttgtttttggtttttgggactgagtctcactttcttgcccaggctggagtgcaatggcgccatctcagctcactgcaacttccgcctcctgggttcaagcaactctcctgcctcagcctcccgagtagctggtattataggcatacgccaccacaccagctaatttttgtatttttagtagaaacgggttttcgttatgttggccaggctggtctgaaactcctgacctcaggtgatcctcccacctcggccaggcgtaagcaaccgtgccaggctagggggaggaattctaacttggcaaggctaagagacctgctaaaaggcaattggcaaccagtgtccacgtctccagaattatcatagagagaaaacagaaaccttctttttgagggagatcatctctgagatatttttacctgggtagcagtgaatcctggatacacagaaatataatataatatttgagtgaaataagtattaaattattatgggagctaaacaaattgccctcaattccctatctgtgcatttttatctgcttttaaataatataaattattattacctatgtccacatgcagaggcagaggaaaagagaatccctttaaaatgattacaagccaacaaaatatttgcaagtgaaaacatatattttgggggaactgccttgttattttaagtttacattatacctactttaattccagaatgtcattacagaggaaaaaaaaaagcttgattagctgagtaacatcacttttttaaccaatgcactctcctactgcttagttccttacagctggataagtgggtaacctttgtgtccatagattcttaggtagatggaatctattgggaaaggaaatcaattttacacatatacatacacatatttttaaatttcagactgtttttatctaaaatagaagcacggattttgagtccccccaaaatggatattatttgtctcattcgatggacttactataaattctagaatggcgggatgttatgaacggcatcgcacatgctacacaaacacaaattctgctcttacgattacaccattacaagataaatgtattctcaagtagctgcagtattctattaaaatgtagacacaagcagaatcatttttattaagaaaaaaagcagagcaaagcatttaaaatataaataaaatataaaaacaattgctttcctattaaatacaaaactagagagcactgtttcaaattggtaagtcatatctgtttaatatgattgcaattatttatggggattaggaaaattaatgtcaaatctaatattttcgaaaaatggaagactcaattaattaaccagacatttcatcctggaatcctatttctttttctttccagagggaacctaaatggagattatattagagaattaagtttgacagttaatttatgaagaactaatattataagtatcaattaaatagaggtgagggatatatggaattagtttgagttgttaaactgaccatttcaaaaattagaagtattttatcactaatacagatttgagaaattattagcaattctaaattattcagatttgcttaaattcaatgattatgatttagatgaattaagaaagttactcagtttgtttaaactgtggaagttaactttagtgtcccaaacctgggacattagcttcattttatttcggctatgccaggatatatttgaagctcgtattctgtacaacagtgtatactattgtagagaatggggatggataataataataaaatatcactttgtcagtaaataaatattcactgaatgataattgtgtgctaaggaatttatatgtatattatctcattcaattctcataaaatctgtgtgatagggcccagtatagttttctgttttccaattgaggtaactgggtcacagagaatgaagcctcgcaaccatggttatgccgctactatgtaaggaatttgctttaatcccccagtatccctactctaatctaagtcagaatctagacatgcagatcaatacaaatacatttcagcctaaaaaaaaaaaactctgaaagcacatttccaattttgccagcagttagttattcatctacagaagctattagtcccagtttgtaacattagcaaaaattaattttcagtctttttcttatagtttgtcttggtagcttttgacaaagttggccataacctctctctggataggtgacaaggtgcagtagtgcaccttgtctttcagaacagcaatactcttctggttgacctcttattcctttgacagtgacttctctgattcctttagaggtgtctcttttaatttctaaaaaatgctgatggttttaatgtgttatttttatgacacatatcccccttgggaaattgctcttgttcaaccaccgtctcatgctactgactgcagtgtagactgctctatgttcaatcatctactggaaaccaccgttgaaagcttgaggtgcataacttagacttatattttctcaaacctgctctcatactcacttaccctcactagaagtcctctttactcctccctcttttttacatgtccccatgttaaatttcattattcagtcttgattcattgattaattatttataatttataattttatattttagaatttttttcaggtgctggggatacaattatagacatgattaagtactagtttcatgaggcttatacagtagttacccccttaaccatggagggtacattccaagacccccagtaatgcttaaaaccatggatagtaccaaaccctgtatgtatgtatgggtatatatatattttttatatatatatatatatacacacatagcatatatgtatatgctatgaatacatgtatacatatatgctatgaaaacatgtatacatatatatttatgcataacacgaatgaagaatgcataacaagaatggagcaatgcatttaaaatataaataaaatataaaaacattactttcatattaaatacatatatgtatgcataacaatattttggtaaactatagactacataaagacagtagccctataagattataataagatatttttactatatcttttctatgtttagatatgtttagatacacaaatatttaccattttgttacaattgattacagcttttaggacattaacatactgtcctaggagcctaggatcaataggctatactacatagcctaggtgtgtaggaggctagaccacctaggtttgtgtaagtacactctatgatgtttgcaaaacaaaatcacctgaaaactaacttctcagaatgtacccccatcattaagtaatgcatgactgtgctgttttttcctttatgtccatacctatgataaaatttaagatataaattacacacagtaggaaattaatcacaataactaataataaaatagaactattgtaacaatatactgtaataaaagccatgtcattgtggtctctctctctaattttattgtactttactcacccttcttcagatgacatgaaattacaagacacctatgtgataagatgaagtgaggtgaatgctttgggcattgtgacataacatttaaaacttgaattatttctggacttttccatttaatattaagctgctgttgaccttaggtaactgaaactgcggaaagcaaaaccaaggataaggatggtctcctgatgagttagggttgagaaaacaaatctgtaaagaaacaaataatatgctttctactagggatgagtgttttgaaaaaacataaaacagatgagtaaataaagagtgaaaaggcatagcattttatctaaaatatacattgagtgcaatgtgtcagttgagtgaactatcttggttgcaaaagtcattaaggctcttaggagtcgtgaaagccttctgtgagaaggtgattttggtcacagtaatgaatgatgaaatggtggaattaatgaagagttggtgaaagagacaaataagaaggaaagcaagtttaaaggttctgaggagtgaacaatttggcacttcccatggtttcatttaactgtaagatttgcttccgaaaatatttctgtctttggtatcacttgtcttactaggtactgtaggctttgggctttttctaaatccagtattcactaagcagtcagagtttctggtttatctacacatacaaatccgtttatatgatttcagtgcttatacctttctagatttccatgtacaactgtgcactgcaaaacactaaggaatagcattcacttagactaggatgtaagcattactccatggagttgtgtgacatgctggccctaaattccgtgccatcgatagcgggaggaagtagaaatcctttgacaattattttcctcttgatctaggatacaccctttgctggagtctgatttcttataattttctactactacatgctacattgtggtagtttatggttctgttaccctaattcccttcctcctccctgtagtgacttccttttctggttaacacgttttcattctttgaacttcagctcagataaaacatatgtggagcagacttgccaagtctagattaaatacctgtggtgcaacactgccaaattgagagacatttgtctctcaatttttcatatcatttgtagtttttttttttttaagacagtctagctctgtcccccaggctggagtgcagtagcgtgatctcggctcactgcctcagcctccccagtagctgggactacaggtgcgtgccaccacgtctggctaattttgtatttttggtagagatgggatttcaccatgttagccaggatagtcttgatctcctgacctcatgatccgcccgcgtcggcatcccaaagtgctgggattacagacgtgagccatcgtgcctggccccgtttgtagttctaaaattcaagtctggatatattagttccccgcttaaaatgcctcatgtcttcccactttctataataaaaagtctactatccttcgcatgacattgcctttattttaaatctccttacaattctcgcatctttttcttgagagtcccattgtcaagtatacacttacggtttcctgactaggccaagtggttcccagcatagctctgtgtaaccctctggaattctacagtcacctgtccatctccaaaggctcagtcaagtgtcacatacactgtcaggttttttctgacccaggcatagaactgcccttctcagtgtctctgcttttctctgtgtggacttctatcacaacacctattatcatttactgagtttagtcgtttgtttttctgtcttcttttgtaaactcatggaggatgagactttatttctgaacagtggagacagctggcacctgagagttgcttatttgagtagatgaacgagtgatttaaaaaatttgggaaggatattgaaatgaacctaattgtggtaatcatattcttaataaatacaaactgagacaaaagatttattctgtgaattttgttttgccctcaaaataaagtagtatctcatttcatacgtagtatgttggaatgttttgccatggctgctatactgattggcattgctcactgctgttcgttgcaatatacaccagctgtttttcagcagaatgagtggtacaccttaaaagccaagtctttctccccgaacagagcgctgggccaggctcaaatctgtcatctaatcactcactgtgtgctgaacactagtctgactttccacgtgatctttctacactttttacacacacgcccacacattatttatgctcaaaagaatgatctgttatgagagtacagtgaatgtgttagtttcaagagataagattgtccagattcagaaacttgtagctgtcatcttctagtttcctcactgcaagtgtggagtaagattggtataacattagttcatcattcttttcagattagaaaatcttacatggtcatctgggagaacagggcaaaacaaaggtcaaatgttatggctagaaatcaagcctgcaaagcaccatcaatggaaaatttgtcatattttatggagaaactataattcttacaaatctctactaacagttctggttgtgttgatgctttggactgtctagagagtcacactcttctgtccattaacttaaaagcatgactttttagtatgttcatttccccatatggggtacaagattagtaatatcgtcttttaccaggtactttctctatgatcatggacatttgcctattctaatcagatccctgcatagttatttaggtaacttccttgaagaatatagtactaaggcagaatgaccatataatttattattgaagttagataactttttgagagcgaagaaagcagtacccatagttaccccaggatgacaggcataaattgaaatacgtggtcaacgtagtatatgggagacatgacttttaggagaaaatatttccaaataactcaaatcttaaaaacctccagagacttcaaacccattctgaaaacataatttgctgttcatatctcaaaataacatggttatcacctggggatagaaagatcatgacaacactgatgtgtgccatgaaattctttccatacttacatgaggttgtcaggtccaaactccaaatgcagaaaaacatgcagagaattgtagttcttgagcatctcttcttgaattagagcataacaattaacttttaaatcatttttggatactattgccaatgctttttattttgggtatctttttaacttaagtgctagctttcagaagtggaaagaaggataaatactgtaattatccttctattataaaatattacatttttaattacagcaattatttctagctacaaatctttaaatgtatgatgttttacttatgtttgataataaataggcaatactttgtgatacacagttgacacaagacaaatctaaataaaaaatgagaacatgagcccccttaattttatggattgttttttaaactgactttgcttctatgcaggcctttcactttctgtaaacacttaagggatattttttaatactctgtaaagtaaatttcagaatggaaaacataactccgaggtgtattttcaatccgcacaattttttttcacagaggtgtagaaaacattctacctgttattaaaaaaaattctatgtatttttggtttgtttgtttgtttgtttgagagggagtttcgctcttcgtgcccaggctggagggcaatgttgcgatctcggctcactgcaacctccgcctcccaggttcaagcaattctcccctcagattcccaagtagctgggattacaggtgcctgccaccacgcctggctaatttttgtatttttggtaaagacaaggtttctgcatgttggccaggctggtctcaaactcctgacctcaggtggtccgcctgtctcagcctcctaaagtgctgggattacaggcatgagccaccacgcccagccacaaattctgtgtttttaatagctttattgagatataatttacctgctataaagttactcatttgaagtataaaatttaatagttttagtccatttatagagttgtgcatcatcgtcctaatcttgttatagaacattttaaccatcttctccccaaaaaaccttgatcacattagcaatctctccccattccctctgctgtccacccctcatgcagcccccagccatagacaagaactcatcaactctctgtctctatatatttgcctctttggaacatttcacaaaaaatggtattatacaatatattgtcttttatatctggcttccttcatttagtatgtttttgagattcataggtgttgtagcatctatcagtgcttcatttctttcactgtctaatagtgttccatttcttggatatactacattttatttagtcattcctcagtgggatctttgggttgtttccatttttgactcttaatgctgccatccacgcaaaaggtttttcagtgtttcattttattgtcttttttttttttttttttttttaacgtatgttttcttttctcttgggtagaattccacctaggagtacagttgctgagtcatatggtaactctctgtttaaccttttgaaaaattgccaaactattttcaaaatttgctgtaccatttcacattcccatcagcaatatctgaggatcccaatttctcttcatactttctaatacttctacatcttttttaatataggcatttcagtggatccctaatgataataggcacttctgattgtttttgtaaataaaatgttattagaacacagccacccccattcgtttattctttttttttttttttttgttttttgttttttgagatggagtctcgctctgtcgcccaggctggagtgcagtggctctatctctgctcactgcaagctctgcctcccgggttcatgccattctcctgcctcagcctcccatgtagctgggactacaggcgcccgcccccacgcctgactaacttggttttgtatttttagtagagacgggctttcaccgtgttagccaggatggtctcgatctcctgacctcgtgatccgcccgcctcggcctcccaaagtgctgggattacaggcgtgagccaccgtgcccggctccattcatttattcttattgtctatgggtatttttgtggtatgatggcagagttgaaccacagagacaacatggctcacaaatcctaaaatatttattttctgaccctttacagaaaaagttcaccagcctctgctttagcgaatcaaaaatttacgtcctcaatcatgttttatttacaagtgattggcgtatgtcaggatgtttagtgagcgatacaggagtatttcattgtatttggagggaatgattgaaatgattttatacagataatcttctgaatttgtgattggtgttatatttcaatttatcaatttattcatatttatttaacaagttattacatatatatttattcggtatagttgtgaaagtcttattatatgccagtggctgtgttagaatttaaggataatgcagtgaggagcaacaagacccctgctttaacagagcttacaatttatggaaagactgcctcttactctgaggaaggtgggagtcatccagtctacagtggagctgagggcctgagggaaagaactgttagaacagatcactggtacaagatctgtagttctgaggaggagactctcctctttgtataatttctcagagcctttaccgtatgaaatatgcattgcatatctctagcaagatttccaaggtacctgagcaccagatctcttagtttgatgaagtatttagggctccacgaaacattttctgaaaaaaaaattacatagaacattgttggtcaagaattgtcagatgaaaagattcttaaaagaccctagaaacaaaacgagatcatttactcaacatctttctttttctagtgctacgtgaccttttaatcttgaaatttttcttgtgtagatgttaggcctgtaaattagttatggtaatgtcaattcaaagcgtctttgaagtttagtttgtcctttattggattcctgtctttcatatttgtctttctaaagcactttaaaatcttggagaagaaagttcaaggaaagatgatataatagattattcttccttgggctgcaatacttttaaaaggattattccttatctttttgttaaattgacttctataaatttttcaaagtgaagtgttttggttctcaaaggctaggagtatccttttatcttctttttctattctctcatattttccttccttgacaaattcatggctgaataacagtatcgaaatgttatcataattctttggctaattatttttgtcaagccccccaaaaggcaaaaacaagcactgtttaaaatgtttagtttggcagcatgagataaattagaagtgcagagaatgagcaacctatgagatcatctgtctgctgctacgtgcagcccatcacaattctagactgttagaaactcaagctcaattacccactttgctattcagttcctgcatactttgcgtgaataactgccccactctgtaactcagattcctcagctgtataatcaatggagttaataatacttatttcagttattgtgaagcaccgagtagatggttggcatgcaataaatatagttaccaacctataacattggtctaaggaatgaagaaacatctgttagaaagacagctttttaaatgaaaatactaatagtgccctgaagaaagatttatctttcttagtatgtcacagttaccagatggaaaaatcagcaaaatacaaaacacttaatgaatataggtatcatgatatcattatgatcataaggaaaaaagtggaacagttagatggggttataactggtaaatccatacttgaacgagatgtctaacatttagagtggagttcccctgggtttattaaaggttagtgttctctatcttccccagggagaattttataaatatataaataacgatatgaattacctctttggataaatatataaatgctatttaataaaaaaaaaatgtgtctgacctaaagctggaagggattgataatacgttgaatagcagaatgatgaccataccatatggataggtgatgtggtaaacctaatttgtgagctaattttttttgaagaaatgtgagaaagatcttttttggattcacaatattatcttcacaaatctttgaaagggaaaatgtaagtgtggaaaagacttcagtatttaaaattactgtaattgcaaaataagagttatagtgtgctaaggagatacttctgacaaaaacagtcccatgtaactatagccagatcaaattgatatgaagtatctgcaacagtggagattattgacctattcagttttagacttcattatgacagtgttagtttcagtggagctactccattctgagggacaaagataaacgttaaggtattcaagaaaagttaaatagttgtgggcagttgttgataaaaggattaagacattaagaatagccatgtagtttggaaaatcaactacaaaaaattatatctggaaatatctttccaaaactagctttgacatttttgtttctacaactccatgtttaggcatgtaacatgaaggaatctctcctcacgtaaaagaaatgcctagggttttaaattccagcatagttgtataatattgaaaactacctaaggtgctcattgaataatttatgtataaccactgagtagaatagtatttggccataaaaaagaatgaagaaagttttctctgaactgatataaagtgattaagaagatatatgttgtaaagtataattacagtattttaacttttgtttcacaaataaggaaaaataagaatgtatgatattttttctctctcttgagatatctctatatctgtttgtctatttgtctgaatctgtctgtctgcttgggtatactttcctggccaaaaagaaaaaaaaaaacaaaaaacagaagtataaacagaaactaaaaaatagttacctctgtagagtaggtgaaaatgggatagagggaataagaatcggaatgtaagttccttgaaagcaagaaacttgctttatatagtaaactctttatgtagttgacgttttaattataaaaatatcctatatatttaaacaaacaaaattaaaaggatgaaaaaatcagttgaatcaatcagacatacatgatcttaaccaaatatcaaattatttactaccatactgagaaaataataatttaagtaacttttacttgattaattaatttgtcaattaacgtactaattcatcaacaaattaagattataaattcaggtaacattattcctaaaaaactccatcttaaattcatctgacttttctatatttcaatattaccatttccccatgatttatacatgcttagaaagataaattctaaagtccaatacaactgcaaaaatatcattagctcttgttttttattatagttgtattggtgtggtcattctcacattgttttctgtatatattgtatgaaagaattagtgagtaaatgcattagcatggttggaagaaaggaggcacaaatatggaatgggtatgtgtggaagaatgctttagtgttggattttctttagaagtatcagtataaccctgttagacatagacacatacacatatttaatacaaacttcaagcacattttcatccatcttaaatttatctgactattctatgtttcaatattaccatttcttcttgattgaaggatgtcattatgcctgtttgtgcatataatgaacagatattgatttctaaataccactcactaaacacacattgaaaactgggaaacttaaatggctgatttcaggtctgcaacaagaaagaacaaattgggttatgccagaaagcaatggcatactcaatggttaataggataaggttgaaaaggcacagatgctctgtatagggaatttattgaccacatttggggtatgtagcttcagtaagaaaaatatagaataacatgttgaattacaaaaaaaatccaagagtacatagtaatacaagagataaaaagaaagacaaaaatggcagttcttttaaaaaagaattatgtgattttattagcccttcttcaccctattgctgatagagggattcctactctagtgttatatggatgacagaatataacacctgacactgggcagatgagatcacctgcagttcatacacattcatactcacatatggcatacatatatatactctcagctaggggaggagagcaccccatgccacagaggcccacacaggttgcacttgggaacaaagtgaataaccagggactgtggacagcaagatttatagtgtcaacagagggaaaggccccagtactcatgggaggatgtggttggtttagttatttttttattttaaaatgtaatgtaaattaattttaagttctgggatacatgtgcaggatgtgcaggtttgttacataggtaaacgtgtgctatggtggtttgctgcacctatcaacctatcacataggtattaagtcctgtaagaattagctgtttgtcttaatgctctccctcccctcaccccctcaaagggccctagtgagtgttgttcccctccctgtgtcaatatgttctcattgttcagctcccacttagaaatgagaagaggcagtgttttgttttctgttcctgtgttagtttgctgaggataatggctcccggctccatccatgtctctgcaaagacatgatctccttcctttttatggctgtataacaatccatgatgtattttctttatccagtctattattgatgggcatttgggttgatttcatatctttgctattgtgaatagtgctgcaataaacatgcacatgcatgtatcccagtaatgggattgctagtcaaatggcatttctggttctagaaatgccatttctggttctagaaatgccatttctggttctaggtctttgaagaattgccatgctgtcttccacagtggttgaactgatttacattttcaccaacagtgtaaaagcattcctatctctccacagcttcaccagctctgttctttcttaaatttttaataatcaccattctgactggcgtgagatgcttctcattgtggttctgatttacgtttctcaattgatcagtgatgttgagctttttttcatgcttcttggccatataaatgtcttcttttgagaagtgtctgttcatgtcctttgcccactttttaatggtgttgtttgttttgtttcttgtaaattaatttaagttccttgtaaattttggatattagacccttgtcagatggataaattggaaaaattttctcccattctgtaggttgtctgttcaactgatgatagtctcttttgctgtgcagaagctctttagtttaattagatcccatttgttaattttttcttttgttgtaattgttttggctgctttcatcatgaaatttttgcctatgcctatgtactgaatggcattgcctgcatattgttctaaggttttcacagttttgggctatacctttaaatctttaatctgtcttgagttaatttttgtataaggtgtaaggaggggttcagtttcaattttctacatgtggctagccagttctcccagcaccatttattttacatttatttatttatttagtttttgttttttttctaggtcaagtttttttttattattattattatactttaagttttagggtacatgtgcacaacgtgcaggtttgttacatatgtatacatgtgccatgttggtgtgctgcacccattaactcgtcatttacattaggtatatctcctaatgctatccttcccccttccccctaccccacgacaggccccagtgtgtgatgttccccaccctgtgacccagtgttctcattgttcaattcccacctatgagtgagaacatgcggtgtttggttttctgtacttgcgatagtttgctgagaatgatagtttcccgcttcatccatgtccctacagaggacacgaactcatccttttttatggctgcatagtattccatggtgtatatgtgccacattttcttaatccagtctatcattggtggacatttgggttggttccaagtctttgctattgcgaatagtgctgcaataaacatacgtgtgcatgtgtctttatagcagcatgatttataatcctttggatatatacccagtaatgggatggctgggtcaaatggtatttctagttctagatccctgaggaattgccacactgacttccacaatggttgaactagtttacagtcccaccaacagtgtaaaagtgttcctatttctccacatcctccccagcacctgttctttcctgactttttaatgattgccattctaactggtgtgagatggtatctcattgtggttgatttgtatttctctgatggccagtgatgataagcattttttcatgtgttttttggctgcataaatgtcttcttttgagacgtgtctgttcatatccagcaccatttattaaatagggaatcctttcctcattgcttgtttttgtcaggtttgttgaagatcaaatggttgtagatgtgtggtgttatttctgaggcctctgctctgttccattggtctatatatccgttttggtaccagtaccatgctgttttggttactgtagccttgtagtatgatttgaagtcaggtagcatgatgcctccagctttgttcttgcccagaattgtcttggctatgcgggctcttttttggttccatgtgaagtttaaagtagtttttttccaattctgtgaagaatgccaatggtagtttaatgggagggaataacatcgaatgtataaattattttgggctgtatggccattttcataatattgattatacctatcattgaacatggaatgtttttccatttgtctgtgtcctatcttatttccttgagccatggtttgtagttttccttgaagaggtccttcacctcccttgttagctgtattcctaggtattttactccttttgtagcaattgtgaatgggagttcatttatgattttgctctctgcttgtctattattagtgtataggaaagtttatgatttttgctcattgattttgtatcctgagactttggtgaagttgcttatgagcttaagaagtttttagactgagacagttggggttttctagatataggatcatgtcatctgcaaatagagacagtttgacttcctctcttcctacctgaataccctttattttttctcttgcctgattgccctggccagaacttcaaatactatgttaaatagtagttgtgaaacaggacatccttgtcttgtgctgatttgcaagaggagtgtttccagcttttgccctttcaatatgatattggctgtgggtttgtaataaatggctcttatttttttgaggtatgttccttcaatacctagtttattgagaatttttaacatgaagcgatgttgaattttatcaaaggccttttctgcatctattgagaatcatgtggtttttatatttagttctgtttatgtgatgaattacatttattgatttgcatatgttgaactagccttgtatcccagggatgaagtgacttgatcatggtggataagctttttgatatgttgctggatccagtttgccagtattttgttgaggatttttgcattgatgtttgtcaggcattgatattggcctgaaatattctttgtggtatctctgccaggttttggtatcaggatgatgctggctgcataagatgaattaaagagaagtccctctttttcaattgtttgcaatagtttcagaagaagtggcaccagctcctctttgtacttctggtagaattcagctgtaaatacatctgatcctgggcttttttttttttttttttttttttgtggtttgtaggctattaattagtgtctcaatttcagaacttgttattggactattcaaggattcaacttcttcctcgttcagtcttgggagggtgtatgtgtccagtaatttgtccatttcttatagattttatagtttatttgcataggggtatttatagcattctctgatgattgtttgtatttctttagggtctgtggtgatatcccctttatcattttttattgtgtctatatgattcttttttcttctttattagtccagctagtggtctattttattaattttttcaaaaacaaactggattcattgattttttgaagggttttttgggtccctttctccttcagttctgctctgatcttggttatttcttgtcttctgccagttttggggtttgtttactgttggttctctaattcttttagttgtgattttaggatattgatttgagctctttctagctttttgatgtggacattttagtgctacaaattttcctcttaacactgctttagctgcatcccagtgattttgatacattgtctctttgttctcattggtttcaaagaacttcttgatgtatgccttaatttcattatttacccaggagtcattcaggagcaggttgttcaattttcatgtagttgtgtgcttttgagtgagtttcttgatcctaagttctaatttgatggcactgtggtctgagagactggttgttatgatttcagttcttttgcatttgctgaggattattttacttccaattatgggatcaattttagagtaagtgccatgtagcactcagaagaatttatattctgttgttttggggtggagagttctgtaggtatctatcaggtacacttgctgcagaactgagttcaagtcccgtatatccctgttaattttcaattgtgatgatctgtcttatattgacagtggggtgttgaagtctcacactgttactatgtgggaatctaagtctctttgtaggtctctaagaacatgttttatgaatctgggttcttctgtattgggtacatatatatttctgatagctagctcttcttgttgaattgaaccctttagcattatgcaatgcccttctttgtcttttttgatctgtgttggtttaaagtctgttttgtcagaaaactaggattgcaacccttgctatattctgctttccatttgcttgttaaattttcccccatccctttcttttgtgtctttgtacgtgagatgggtttcttgaatgcagcacactgatgggtcttgactctatccagcttgccattctctgtcttttgatcagggcatttagcatgtttacatttaaggttaatattattatgtttgatttgtgtgtccttggtctttgttcttcagtgtgtttttgtaatggctgttaacgatttttcccttccatatttagcccttcctacaatagctcttacaaggcaggcatgatggtgacgaattccctcagcatttacttttctgaaaaagatgttatttctcctttgcttttgaaacttagtttggccagatgtgaaattctgggttggaaattcttttctttaagaatgggagaaaatttttacaatctacccatctgacaaagggctaatgtccagaatctataaaaaacttaaataaatttacaagaaaaaatcaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcagtcattaaaaagtcaggaaacaacaggtgctggagaggatgtggagaaataggaacacttttacaatgttggtgggactgtaaactaattcaaccattgtggaagacagtgtggtgattcctcaaggatctagaactagaaataccatttgacccagccatcccattactgggtatatatccaaaggattataaatcatgctgctataaagacacatgcacacgtatgtttattatggcactattcacaatagcaaagacttggaaccaacccaaatgtccaccaatgatagactggattaagacaatgtggcacatatacaccatggaatactatgcagctataaaaaaggatgagttcatgtcctttgtagggacatggatgaagctggaaaccatcattctcagcaaactatcgcaaggacagaaaaccaaacaccacatgttctcactcataggtgggaattgaacaatgagaacacttggacacagggtggggaacatcacacaccagggtctgttgtggggtgggggtaagggggaaggatagcattaggagatatacctaatgtaaatgacgagttaatgggtgcagcacaccaacatggcacatgtatacatatgtaacaaacctgcacgttgtacacatgtaccctagaacttaaagtataaaaaaaaagaaaagaatgttgaatattggccctcaatctcttctggaatatagggtttctgctgagaggtccactgttagtctgacaggcttccctttataggtgacctgacctttttctctggctgcctttaacattttttccttcatttcaaccttggagaatctgatgattatgtgtcttggggttgatcttctcatggagtatcttactggggttctctggatttcctgaatttgaatgttcacctgtcttggtaggttgaaaaagttctcctggatgatatcctgacgtatgttttacaacttggtttcattctgcctgtctctttcagctacccctatcagtcataggttcagtctttttacataatctcatagttcttggaggttttgttcattccttttcattctttttttttcctaatcttctcttcctgttttatttcagcaagatagtcttcaagctctgaaattctttcctctgcttgatctcttcagttattgatacttgtatttgcattgtgaagttattgtgttgtgtttttcagctccatccggtcatttatgttcctctctaaactggttattctgtttaacagctccttctgaagactacttccgtcagtttatccatctcagcctctgcctagttctgtgctcttgctggagaggtgctgcaatcatttggaggagaagaggcactctggctttttgagttttcaacattttttcattgattctttctcatcttcaggagtttatccagctttgatcacagaagctgctgacctttggatgggtttttttgtggggacttttttgttgacgttattgttattgttgctttctgtttgtttatttttcttttaagagtcaggctcttctttcataggcgtgctgcagtttgcttggggtccactccagactctatttacctggttcctttccacacctggaagtgtcaccagtggaggctatagaacagtaaagatggctgccttttctttcctctgggatctctgtaccagaggggcactgacctgatgccaacagaaatgctactgtataatgtgtctggcaaccctaattgagggttctcctccagtcaggaggcaccggatgtgggactcactaactgaggcatgttggctgctccttggtggaggaggtgcactgtgctgggaggaatcccacttgtctagactgcccagattcctcaaagccagcaggggcaaagactaagtctactgatttgcgaagactgcggccacccctccttctaggggctcagtcccagagagattagagttctgttgctaaaaccctggctggagtttctgaaattcttgtagggagggcttgcctagggaaatggtgtgggtaaggatccagcctaaagaggcaatctggccacactctgccacagccacggtgctgcactatggggaattcctccagggtccaaaccatccattttccctggcattgcaggggaaagatggcaaactggagctgcagtgatggcggccacccctcctcccggaactcagtcatcttatgcagcaggcagccacagtgatggctgccgcccttccccttgaaagctcagccatcttaggcagcatgcagccacagtgatgatggccacccctccctctgggaactcggtagtcttaggcagtctccagccgagtagccgctgagaatctgcacaactctgcggttcagacccaaggctctggtggcgtgggctgacaagggggatctcctgatctatgggttgcacagatctgtggaaaaagtgtggtttcccaggcagagtagcaccatcactcaccgcctccctcggctgaaggtggtagctccccttgccctgtctgactcctaggtgggctgtggcaccactctgcttttccttactctccgtaggtcacaccaaccacctactcagtcccattaagaagacctggatacctcagttcagtctgtttaaataattcttcaagtttgcaggcaactgaaactcaccagttaatgattaagtagtagccgcacctgttccatttgataagaaaggttatttggagaggatcttagctctagaagcccaatggggagggaagcttgtggttaagttattggaggccctgtgatttcaccagatatccagtcagcacataattttagacattagttcttaggctttatatcatataataaatatggctggaatgatagactagaaaactcttgatgtttctgtcctaatattataatttattaatgaaagaattatcaatacattctaaaatcattgggcaaaaagtgtttaagaatagaatattcatgttttcaaagcatcattgcacatattacttgaaaggtggaacatgtccctttaaaatggaaagatcatacagtgacaatcttaaccaagtggctaagtttggcattactgatggtgtaaagcctaactttttgtttcttctgatgacatgcaatgggagattcactacaccagttttgtggtattcttaccaaaaatgttgacctcagtctaatcgcaaaaaaaaaaaaacaaaaaacagacaaatctatgatggtatgctttgcgagacagctaccctgggcttctcaaaaagttaatactttaatattaaatcaaaatatgtaataatgaataataggggaaaacatcaactattttaaattagataagactaaagtaacgtaacagtgaaatgcaatgcatgaagttgcatgacagaccgaaaagatataaagaacatttacgtgactattgatgaaatgtaacgtaggttgcatgttgtataattttattaaactgtttatttttctcaggtgtggtaatggtgttgtggttatatattcttgggaggcccatacttaaatataattgtgcaatctcctttggatcattcaacaaaacagttgtgtgtatgtttatgttaaaagagagaaggagacagagagagagaaaaggagagagacagaaaaagagagagagtgagagaaggagagaaggagaaaaagtgagagaaatgaagtatatatggaaagatgttgagaattagtgattctaagtgaggattatgcagatctttattgtactgttctttcaacttttcttcaagtttgaggtttttaaaagtaaaaaaaaaaattaccacatagctgaaggtgaaaacataccaattatggtggataaataacttaaacagggagtcagacttctgctcacatcccttatcataataaaattgcagaatctaagaggaagtggaatcttaagagattttagaagaaaggcagtctacagaagacaagcaatttaaacaggcctctcagcaacagccattagaaacctaaatacaatggaatgtaacttcagtgagctgaaatagcttaaaattctgtacctagccaatacacttttcctgagggtaaaatatatgtttgaacagataatctgggataagccaaaaacaaatactcagtaaaataaatgttaaaggtataatgtaaacagaaaaaaaaatccagatgtgaaagtaatgatacaaaaagaaattatgagcaattatattggcaaaaatgtgactaaatcaaagcaaattatgactatataaagccaaagtaatttgaaattttgtgaagaggaaaaatatctttcaaaaaactgattaaaaaattatatacacaataggaaggggagtaaagtaactgtatactatggcttttgagtagtttgaagaggggtaagttaattgtttttaaattagcataatcacaaaaaatatagatgcaaagtacaaatttctaaaaatagaggagaaaaatagaataagaaaataggaggcacagaattgagactccaagaatatgaaaaatacaatccaggtgatagagtaagattgggcaacagtgacagaataaagattgaggaataggtaaaccaatgaaatatattgttaggagagcatttccaagaccacaaagaaacttagcagctctcaattataaataaaagttattttatgataatactaaaactcttattgaatttatgagtgagccccgaaatagaacatgtttcataggcataagacttgattaaatcactattttctctaggagggaggcccctgtgacctggggggaagcctacacacagctctcactgatggacaagaacagtggccatcccagtcaaactaaacttgtgtgaagaaaaattaagcctagacatcaccagtctgtgacctctagtaccacccttgtacctgtatcacattctactggtataactcaaatataagttcagagtgaaagcactgaatcatgaaactaagagggtaacctgtagaagaagagccagagatctgattgcatgttaggcttcactctagactgtagcctctgaggattaataaaatctttggaatgcaaagatcacttttcctctgaataagatttgtgaaatctctagaattatgcactttcatatacatctgtggttctgcctaattttaatgggtactgccttctgattctgtgggaagaaaatatcatgggactttgaaatccgtcagttgattgcacatttcttgttcagtcaaaatttacttagaattccaagtgtgcatttactaaaactgtgcttgaagggttggtagtgggtgattttaattctctagtattatatgtgattgcagtctggaaggctgaactattttggtgatggccaaccatgcagtaagaaggttaacacaatttgcaatggtaatctctctttcatctacacatttcagtcaaccttggcattatctctaaggccgaatccaagtgcctgtaagccagaagccttcaggaaagagcagctgtttttgtgctctctcacatcttgaattctaggtcaaaatgtcatgtaaaagttttttcactaaaatatctatattgatttctaggaataaaatagaaatgcctggaggattctgtgtattttccctgtaagtcactgaaatatcctggtaggccatcaagaaataaaatggattttgtctccattgtatgattgagtcctcccttgaaatccttgctattatctggaccaacaaatgtgtagagtccagactaagagtggagttgattcagtgtatgtatccatgggattttggtcaacaaaacaggactacttaaagccttgttgggtaggggtttattataggaatcagaccttacacaaacacggaagcactaactgaagagaaagtgtttaagggggactgggatgatcagagaaagaatcactggctggttttcctgaagcgctgactcaggtagacaagaagccaagcatgctctactgccaaagtaggactctgaagggggcacttcagcaaggtctgtaggaagatgttgtctttggtggccactaccactgtgagtccacagccaaatgcccagtggtaggtttggggccaccattagtcagcagggccagctactgaaaaggtggactagattcagagaagaggagaataaggatacactgagtcttgctgggtacccctctacgtatcttaggcatctatcttatgaaaaccttctgaaagtagtagcttctgtttctcttcttccttccatatctcactgaacgtctctcttctggccaattctaatgtagaaatatcaggaaagggtattgggaaatgtaatactccatatttgcctgacataagcaagataatctagttagaagctggcaatttccttataacctaggacaattaggaagtagaaattagagtctaaagcagtctgcaaactaggaagacagtggcaaacaggagtaacaggaaacgaagtcaggtgcagtagacaaacatctgtcctggtgttataggttgtgccagtatatgggaggctgagggtcagaaggtttatgcaaagaaccaaagcgaagcaagatttacctctgaaatgacaggaggtcacaggtacatgaaactcaaatgcattacaggtttttttttttctttgttatccaaatataaagagcaggagataaatttcatcaccttttgaggtgtttgttaaaacatgtagatttctgaaacctccttgcagacctaggaaccggaatctctagggttttgattcaggaatctgcattttaaatacaatcctcagatggttcttctgtgcagtctagttgggaaatatatgattcgcagagtgacagattcatgctaacgtcatgtcaggtacttactgatctgcttcagcactgagaacagagactgaattagaggaccagatatataagtgatttttttttaactgactcatacagtagattttttttttttttttagagaagataaaattcaggctggagatggcaaataaattattcatgtcacctacctagtaagtgactgggcctatactctaatttagatctacttgactccaaagtgtaccctttgagtgttgaatggagtaaaaggcttcaggcttgcagaattactgacttgcttgctaaacattcatcagtgagacccctcagggaaggaaaagtaatactggtctcctattaaactaagtctgtgtggatttctaagaaaagtcctggaggccaacattcccccaaataaaagaactagtaatggaggaaggcaggtcctgaaaaaatcactcccaagaaaaatgagaacttcacactcgctttgttttctgccccctcctcctccctctctgtggacccagcacttacaactactatgacctcttccatctttatgtgtcttcatcataccaagtattcccctttcttatctgaaaaagaaaaaaaaagaagaaaggaaaaaaaaaaacgacatcttgatctcgtttatatggaattaattttacagttaataagtaaaacctaatattttttgtctacttttttgggagcaatatggtgaactcatattggcaaagttatttaatggttttatgaaggaatagataagtgtgagtgagaaagtgtggaatcagatcgcagctgtaaagataagctgaactatggcagcgcaatgtgacccctagtccttgcattctaatttaggttctgctgggaagctttacgagattattgaatacctttctagcaattagagctggcctggatggttccggttgccttgggaatttggaaattcttctatgtgaaagatgtttctgcaggagctgatcattatacaccgatgttacaaacaattaatttataaagtacaaagtttcaatttcacagtgtttattttgtttttttctgttagctatctgttcaccagataactatcattctttccatatcttgtggaattcctgctaggactaataagataggaactggaaaatagctttgaaaatagaataattactttgaaaatagaataatatgtattatatgatatacatacaggaaagtactcctgcaacagcaacaattgtactgattctaatatcccaaatccagcggctgctcttcaccctctctcctagcccaagccatcatttctaccagtttactaccacagtctcttaaatgatctgcctgtgttctgtctgcttccacaagagtccatcgtctactcaaagttgttcagatcctgtcatttccttgccataagaggagaatcaggacaagttttgccacggcatcaaggccccgcgtgatttgtcctcacctgttttcccagtgtcatctcctcacagtcttccttggttatctgcatttcagcatcacagacttgctttctagtccccaaatgtgcccacctcatttccatctttgtctctgctcttcccgttcatttccaatactacctcttcagagagacctctttaaaccagcctacataaatgaaccccactctctccctctatcctagtatcctgtttagtctttttattaccgtacttatcactgtctgaagttatctacttatgagtctctatgtgtattattagttttctgctattataccgaagtgcaagctcaataagggtaacgtctttgtcttatatcctcagttcctagaagaatgcctgtcagatactgggttcaatgtgcatgtggaataaatgaatggataaatggaaggaattcaattatatttgacatttggtaggcagccagattcagtgaaattatggaatactggtgcctcaaaacaaaaccttttcttatgtcatttcatatacgatagtgttaccaagtatcaaccttttcagccacacagcctgaaataatgaaatggaacatagtagttggacttggaaccaacttctgccttaagcagaaagctcatgcagaatttaaagcgattattaaggaaagaaaatcctcttcaacacccacagaaagatagggcattgcttttcaagtcataagattttcagtaattagataggagaattataaatatattatttgcatgttacacattcctgtaactctaaccatccaaatatggtttctatattcaaaataggtagcaatttaaatataaatgagacaatgcctcatacatacaatataatatttaacttaaaacaccgagatggttaattccgtgtgtcagttttgctagctacagtgcccagatatttggtcaaacattcctctggatgtctctgtgacagtgcttttttggatgagattaacattcaaatcagtggactttgaataaagaagattaccctcccacaaggtgggtgggctcatccattagtttaaggtcttatcagaaaaaaattgaccttccttaagcaagaaggaatgctgccagccaactacctttgtacttgaactgcaattcttttccgcgtctccagcctgctaatctgtgccattagattttggactctgcagtctccagggacaatagcatggcacagtccctaaaataaatttcccaatcttcctctctctccttctcttcttatttctcttaaattccctttctctttcaatctctctatctccctctctcctttccctatctctctatctctctctctccctctcagtatctcatacacacatacgtacaaatatatgtgtgtttacatatatgcatatgcattatatatatatttatacacacacatcttgtcctgtttctctggagcattctgatacagacacatttctgattatagatttaatatatactatattgtagtttaaacatatagatatatagagagagatttaaaatatactatgttgtagttcaaaatatactattgaaaaaatttacataacctgtccaaatgtttatttggctattaattcaattaaacagattgacctcatctatcatttctgatagattacttctaagaaacagaagatggtaagtaatatctcatgcattatgaagtcatttaaattatttaacatgcattaaaggagaaattcaatgtagctcatttcttcaggtttactaattaaagtcagtcttgactctagaaataaaaaaaaaaatgcgtaagaagagcaactgtgacagcattaatattcagtgaaattgatgaccttagtgggttagttttatataaactgttacggtacgtacaacttgtcactgtagttcaaagttatgttcaacacaatggttcttcttaattgctcaagacactccactgtgacattggctacttcggctgcaatagagagattaaagaatcaagtcattgtattttacagttaacaggattgctaataaagaatagtagcagcatgaaaaattgtagagaggcagtaaaactgaaagctcaagggtctacctgtatagactgcgaaatccatatactgcaccaagattacaaatggtgattaaagaggagcccacgatataatagattaaaacaaaaggttaggtgtctaacagaacactggatgattctgggaggatggggcacataagacgttataaaaacagagttatattccaaggccctttttaaattacaagaattacttgtacttttactggcattagtttttgcctgcaaatgttgctagattcatcatacttttagaaagctgattacaaggttttggtctgttcccatgaaattccatccccagattttgtgacagtagcccttcatttagcaaaaactcatgagtttcttctctgtaccagttgctgatgagcttagtcagttattttttatgctgtcactgtttagggcaaatcaaaccattgtctaaacagttcactttggaatattgtgaaaaaaataaagtagagatccacttaaaaatgttgaatgtggttcttgtctttatctttgttggtactttcctgtcattgccataatcattggctccattagcacctgactggccaatcaggtcagttgactttgttcatctgagccactgaacatttctaaatccagtctcatactgcacatcaactgtggttccccatttgtaaattaaaaaaacttaaccatgtctaacccacaggaaaataatagtttctttttttaaatatatatatatttttattatactttaagttctagggtacatgtgcacaacgtgcaggtttgttacgtatgtatacatgtgccatgttggtgtgctgcacccattaacttgtcatttacgttaggtatatctcctaatgctatccctcccccctccgcccactccgcaacaggccccggtgtgtgatgttccccttcttgtgtccaagtgttctcattgttcaattcccacctatgagtgagaacatgcggtgtttggttttttgtccttgcgatagtttgctgagaatgatggtaataatagtttcttagtttacttgttcactgaaggactggatgcaatggctcatacctataaacccaacactttggaaggccaagatgggaggattacttgaggctaggagttccagaccagcctgggcagcgtagagacactccgtctctataaggtatttgaaaaaaaaaaaaaatagctaggcatggtggcgtgcaccacctgtagtcctagctacttgggaggctgaggcaggaggatcccttgagcccaggagtttggggctgcagcaagctatgattgagccactgcactccagccaaggtgacagagtgagaccttgtctctaaaaataaaaatttaaaaagttattaattgaataggagtttggtgtgggtggagttaacagtcagtaccactaatctccatattttaatgtggtttatataaactataccaccaaagatataattatttatattgaaatatcagcatgcctaacaacataattggattctatgtttatttgcaatatgagtaagtcagaggaaaactgatagagtaggaaagtcagatttcaaaggtgaactgtataggaacttgccctttggtcttacagtgctgtctcctattattttaagcattcaccttaatgataccatgaaaagtattctcaaatgggatcatataggaagccaagacacagactgttttagcttaaagggccctgagaattgagattgttttgaattcctaaacactttccttatgttataggccaagcccaagtcccaaatgtgctttactctgttccactgagttttaaaactttgtatcagttaccaacattgaatattgagagttttgatatagagatagtaattttcaatttatttagaagattagaaaatgtggtacacatccctgcatgactatgataagctggagctgagaagctacaccctctttcagatgagtcctgtgatactcagggcttcccaatccccaccagccactttattttttacatcacctgcctagaaactatatcaaatgacttctcagtcccttagtctgaatccttcatttttcccatgtaataatttgagttatgaatagaaatagtaatttgcctgaaattgaggaaaatgaaactcccccttactaagccatcatgttatatccccttcttccttattataaaaaaaattatgctgttcagggtggatgcacgtttaagtcaaaatatagaaagtaaacaaaaccattaagttcttaggcacatttgcaaaaatgactcattatataacatgctatgttccaatattaaaaagcagaaatcagttggggatttctgggaaatgtttgctctacttcctctttttattccaactctatttccttctctgtcttcctatataaaacattaagatgaagctgaagcatttatatcatgatgacgaggtaacaattattgggacaaagcacaacataaatatcatagacaggaaagacagaagagtctaaatatcataaggcgttatgttttgttttttgttaaatatgatcctgactgacataatcctgactgatacacatatatatttcacttcccatcacacacacacacgcacatgcacatacacatgcacacacatgcacgtgcgtgcgcgcacacacacacacacacttctttgccctctttgcctcctcctatttattattttattcaacagagagtgactagtgcttactctatgtcaccatattactgcactggccctgcttctacctggcagtgatggagatcagactgtcacatattgcttctaaacttagtaggctcatagaaattaaaaatagcatgttctacctagagctttaaagatcattacagtggggctattagcactgtgaatgggaacacagcctgactctgggtaaaaaaaaagaaattgaagagattatatatgggagattctataattactttaacaaaattaagagataaggcaacaaagatctaatactgtaagtcccacctgcattatttgtgctgaaacaccatgtctgtacattggctgtgacatgtaataccactgaaacacagggtgtttagcaaacatttagttatttccttaagccacctgggctaacaggcaagggattcctacgtagatggctatactgaaagattttgacaccatttaaaaacattcttaggacttttgagtgaattatgttttcagattatttagtttgggcaggttaaacagactgtttttatacaaattctaaaaaagttgacaaccctgagcctcaatttccttctctttaaattgatgattttgatgattctgaattgtaccactattaagttcctgctagatctaccatgtttagaagtctgtaacgtcactctctaacgctgtttatttttttcttctttgcccctgtgtgcacactgctagctcttctattaatctcagcagatgagggaggtaatttcgtttgaggtcaccaaaactgtaggctataaataggaagtaagatagtcattctatagtaaccataaaaatagttctcatcacattgggatgaaacaaaagtcatgtcacctcactctggagacaagagatttatctagttatttgtaattcctatgggctccagatgcatggacagaaagaaggaagatggaaacatggaaggttaaagacacatcagggcctatcctttgcttagtgtgacacaatcaaaggaagaagaccggctccctttgggtttaaccgctttatcaagtgccgctctatacattacccagagaaatgccttctgaattctagaatttcaggcattgcagtaggcagttgaagttgtggcagcagcacataggaagctttttaaacctctccatgcagctctacgatgattatactcattcattagcctttttcaacaaacaatggtttagcagctggtatgtactaaacactctgctaggccttcaaatatggcattgcacaaggcaagatctttgctatgaaaagtgcaaatgtttaaacaataacaaggtagatgttgtattagaaatagtacatggtaaaaaaaaaattaacaaacaaaggactgggtaacatgactgagggtacatcttagtctgtttgtacactacaacaaaatacctgatactgggtaatttatataaaacagaaattaatttttcacagttctgggggctgggaagtccaagatcaaggcactgtcatgtgatctgatgagggctttttttgctgagtcctcacatggtaggaagagaaagggcaactagggcaagcctccctaacactgagtgaagccccttttaaaagggccttaattccattcatgaggcaacagctctcattgcttaagcatttcttaaaggcttcccttcttaatgctaccgcattgaaaacacatgaattttggaggtgatttacgttcatcgtgaattttggagggagcaaacacattcaaaccatagaaggatgtgactaatgcagtaaagattcatatcacttttattctgtgcaaagaaggaaaaacttattttatgttgttactttagtttgcatgtctgagagagggcaagtgatccctcacatctagcttactaagatttattcacttaaggtaccagaagaattctccaccagagcaaaaaaaaaatagtgagaacctaagaattccttcatttagaattaatcctctatatgggaaatatatgtttttaaaaactgaactcatagaagcagagtagaatcgtagttaccagggtctgtttagggtcagggtgggggcattggtgcgatgttggtcaaaggatacaacattatagttaaataggaggagtaagttcaagagatctgttgtacaacatggtgacgatagttcatatcaatgtatgatattcttgaaaatccctaagagagcagattttaagtgttctcaacacaaaaatatatgtgatataatgcatatattaattggctcaatttggcccttccaaaatgaatacgtatttcaaataatcatctcttacccaggtgatgggttcttaggtgcagcaaaccaccatggcacatgtttacccatgtaacaaacctgcaaatcctgcacatgtaccccggaacttaaaaaaaaaaaaaagaaacattaaaaagtagacaatttttgtcaattgaaaaaatttaataaaacttagcctagggtattctaggtaatttacatagattatcccaagggaggaaggataggtagtgtgaacctcttaaagcaaaggtggagtgaagtgagagttcagattagtggcgtggagagtccaacccagttggaaagcaaagcagtaataggagtcatatggaggattctcaatattcacctttgttgccttaacacctagcaggggtagaaggagccaagacttaatagattaatggagtagggacaccaacccagttggaaagcaaagcagtaataaagaccaggtggcaggactggcacaggtgagtactggaaacaaactgagtgagtccacattactttcattatcctctttaaaatgtgtctttccagcatttctgggaagagaaaaacaaaaccagagaaaattcatgcttctagggaaaaggagaggaaatagatagtgcaatagcaagaatgagagtattaatgacaggaagtaatgtaatcctaaagggattagtgaactaatgcttataaatggctcaagtgcctgggccaaatgttctatgtgagaggagctactcttctgttactttctctgagctcattaacaaccaaatggattataatgggcttcaacaggattaagtgacaatcaacaatcaaagtaagacaagagtttattatgaagaatattgtgttcaaagattaacattaaactcgtgaaatatattgtagaaacttcagattacattttgctatgattttctttttatatgtcagtcttcattcctccttcagaatgctctttttatgatgatttgtacataattatttttaggaacccattgatcaatgtcctagtaatatttcattcttttatatcatcttttacaataaaattaagttgctttcagactaatttaaaaataatctttggggttaatgttttgtttccaaattatgaaaaaggaaggaattcaatcaaatattgcattctattaccaagtggattttaagtaccatatgctgtgttttatgccctatattatgtagtcagaatgaaaatgtgctccatgttttcagaatatgtactaccttcatctttcacattatttcaaatagtgagaaaataaatatacatccattcttcctcctactttctttccttatatttatctcccaactagccaccagacattctctctacatttaatacctacaaagagggctggctgctattcaggtcatctggcaagtatcatgttttctccagtatggaaaaactaagacatatgtgttttgtttacagtgtgccaaatgtgccaattcaatgagtttttggatttgttggcaaaaaaaaagagagagactgaaaaatagggaacagcattttttcctgtggccagtggtcatttgttggcacaaggaatttctgtattataaatgacactcaattctctctttgatggcctcactttgagaacagattttgaataaacagatcttaggcacacagaatttcaatcgtcgaggtgtatctgcagaagtaattagatacttgcaagtgacttttaatcacttcaacttgaatccatgtgttgcaaaaagatgtactagctaatgtgattattccaggaacatctaaaagttttcactgagtaacttttttttgacatgacaacttcttatcgtctcgatcttgaagcattggcatccagataaaggcacatgctggcatggggaaagggggggggggataatccacttgacaactggtaaagataatcatatttttataatttttgataaataaattaacttacaagccttattatgactctagtttcttctccctttaatcagttacatctattactgccagagtaattgttctatttcatatattttgtcatataatccacctcctaagaaagactgttattgtttacagattatttctcttcttaggatgacacacaggtcctttcacatgtggtctctacttggtctcccagactcagctagcctccatgagtatttcctagtgtagccatattcaacacactccctgctccctgaggtgcccatgcatttttgcccatggtctttgtcttccagtagcattgaaggagaaagaggaggaggaggagcggaaaaggagtggggagggatgaaaagaggaggcccagagaagaaatgagaggaaagaaatgtccaacgaagggaagagaaagaaaggaagaaagagagtgagagacagaatttctccacatttctcaagactcacctcaagtgatctctcctcttcaagccttccctaaatcccctgacagagagccccatgccaccataccttatgctgtgtcaccctctagcaaatttacatggtataacaaagcatgcttatctttttctccattatagattatcagaaacttgagagaagggtctgagtcttgctgtctctgtgtttcccatcacctagtagtaactagtccaaaactatttttttgaaagaaggaatgaatgaaacctgcaaattaattaaaagcgagagaacaaacaaaataaaatagatttgttcaactctgtttgtataatatgaatagacttctaaattagtctttctagttggtaaattggaggaaaattaatgaacctgaaaaaatgaaaagtaggtgtcacattataagctttctgagaaaatgacttgaaccttttatccttgtgttatcctcctttcccggcgctgaattatcttctaaaatggtttgctcaagtagaaagttaattaatttttattaagcaattagaagaaggaaagcaattttcattttcaagtaaaagaattcgaaagaaacagaggagatgactaatcattaggaatggcttagacgccgaatggtttcccacatataccaagataaaaagaatgcgcaggaggaggatgatccatggagtaatataatactgtcagtcagggtacagacaggaatgtctgccctgtcagctttgatcataccatatggggactggaaaaggaaaagatggtgcttttttacacatattctctagcttccgtttatactgaaaagttattgtaaagagaataagcagatagtttccatggttggacagcctttgtaagttttgcagatttttattgtttttaccaacagtgacatgcttaattcttcaagttgccacactcaactgaattgaattttagtgttctgttaactataaaatataatgattcatttttcaaagtttccctgaagcacatcagttcaatgacatctgtaggttaagaggatgccttatgattcagatatatgagaattcgaattcagactctataattgaccttatctgtgatgttggacaaattaaattttatctttaaagactgtttttctcagatataatatagaggtgaataacaaaaatttaaaaatagctggaatagttggatacatgatatatgccagacattctttcaagtactttatagaaatcaattcatttaattataccaataagtttatggtttaagtacaatgattgcacccattttacagaggacagaagtgagaactagtaaattatgaattatttggtaaatgaagtgtatagcacagtgtcttgtgtacagtaggcagtcactagctggaaacagatattgcttatttcttcatgtattagtctggattctccagagaaagaaaaccaataggatatatatgtgtgtgtgtgtgtgtgtgtgtgtgtgtgtgtattcctttaatatatgtattctctaatacctttatatattatatatataatgtagatagatataggaattagcatatgaagttatagaggcggagaagtttcaggatctgtagttggcaagctggagactcaggagagccgatggtacagttctagtgtgagtctaaagtcctgagaaccaggaaagacaatgatttaagtttatagactgagtgcaaatatgacagcaggggaagactgatgtaccatttcgagaacagttgggcagagaaagcgaatcatctcttattctgcattttgtttgattcaagcctccatggattggatgaggcccactcacactggggagggctgtctgtattactcagtctgttgattcaaatgctagtctcattcagatacaccctgaaagatgcactcagacataatgcttaaccacgtgactggacaccctgtggtccagtcaagctgacatgtaaaactaaccatcacaattcattatggcaatttcaaagaaggaaaacattggcgaaattgtttacaaatgaattctcaaaataaatgttctaattatattttacagagacacagggggaaagcacaaatgatgatggagtctggtttatacttcacacacagaaaacattcattcaatgaataattgagatcatcagttaattagaggtggatatacaaaatttaaaatattgtgacaggtaattgaaaagacaaagtataagaagcattaaaatgagaagacaatttaggaaaagtaaagccggggatatgagggcaaagaatgtaaaatcagacaaatagacaaaacatacattaaaatttgtttaatacaagttaaaaaagaataaaaaattattcttagagtaataaatgatgactgcacagaagaaatatctaacgctagcattttatattttacccaatttcaatccattctcagtagcaccagtagttcacttttaaaacaacaaatctgccatctacattaaaaatgtcttagataatctccgctgtctaaatgaaatcctaattcctttgtactttatttaatgctcctaaaagtttttcttactcttcatttgcagcctcatttctggacacagttttcccaatatacaataaattctatccacaatcaacttctcataattttccggaaacacaatgtgtatgttctttctttctttatatttcttgtcttttctagatgattccattcccctttttccaactagtgaatcctcttccctagaaggcaagttgatgttgatgtgataataaaaggaatgataatgtcatgggaaagaagaggagaatgttggggattatagctctcttttattagttattttggccaatccctgtagaggatatcttaactgagtattttatttaattcttacagcaaacctcctttttgttatccatgttttattgttgtgaatgctatagcttaaagagattaaatgacttatccaaggtcacccagttaataagactattttactcagttcaaataccaaactgactttcctaagaactcttttattaagaataaaaattttaaaattcgtaaagccctacaacgttctttttatattgtatctaattatatcagaaatatttacacatcagtctactcaatttgattttgattttcttgaatctaggaatgagtttcatccaccctgcttcccccatcccctgcagtgttagcttcatcacaagcagtttataatcttttatttaacataaacaaatataaaaaataaattctaagtatacacgagtgaaggcaacatactcaatagtacaaacaagaaatcaaagcgaattgcctttgtcatttaaaaaatttggaggaattaaaccttattaaaattccattaataacgttttctattaataattcccttattaaaatactggaatgtcaatagatacaggtattgaataaaactaagcacataatttaatgatttttcctaattattattcagggaatgtctttgaaaagagaagtgcaaaatatacaaaaacagaaagatcaagaagcatgccaaattggcattgtgattgccaaagcaaacagaacagtctgtaaattattatttagggattggggtggctcttgcatcagtcacaaaaagtgtggaaattaaataatatgctttaagaaatcttgtcataagagaacacagcatacttcttcctacatctatttttaaatgaatttcttatatgattgctcatgaagaggaccaatagtagtctttattgtttataaaccaatcaatatctctcagtctcaatgtgtaacctctctgtcaccattaagacagcagacggcaaaggaggggcaataaattttagcatgtaacagatgaagtagctgatagggtcattagagtaactatcagggatagagaaagctgtctcccaatatcagttcccacaactttgacttttaggttgcatttcttcataaaattcagcctgatttttctaatttccaaaattctacacttattttctattttatcttgtctctttttggatgcttttaaaaattattcctctaagtgtatacttggaaaaaaaattaatgtttctttgcaacttcaccctttgattgttatatatgcattcaactggagatgaagttgggttgaaatctggaattcaagattattttataccaaagtatatattgttttcaggtaatttttataatgtcccaaatacgtaactttttaggctttatttaattatagatatttggccgaataagcacaatcgaaagtttcaattaagagtctaggacacaaagtttggggaaaaaaaatcatagtattctaataatatgtattgctttgatgctgtatgtctaaaagcactcatgaatacctagtgcacatgtgtcaaaataaaacttttttttagagtataacaagttctttagaaaactttttgcatcaaatggtgtaaaaatgaaatcattttatataaatttagaatctgtaaaaggtacaaattatgctttgctcatcaattgtatttatttacatctaatcaaccccatcttctgtttcctactcaatattagctctattatttgattggtttggatatataggggcgtgttatcaaattatacgcacccttgtccttttcctcctttcataagtttccttcaaatttataattcttattacttatttaaatgaataatgatggagaattaataaatagaataaatataaaaagatattaatcatataatcgctcaacacattcctactgaattgattttaatttttgaagaattatcatattatattgaataaagaattagctctcaaataaatacaaataatttcttaggggaaggctgaggaggaagactgaatgagaaggagctttggcaattgggtgttaaataccatgggaaatagtcaaactcatagtagataagaatagaatgaatgatggttgccagggactgcgtgaggagaaaatggaaaattatttttcaatgggtataaagtttctgttatgcataataaataagttctaaatatctgatgtgtaacatagtatctatattaataagacagtattgtgcactttaaaatatgataagagtatacatctcatgttatgttcttaccaaacacacacacacacacacacacacacacacacacacatttattaccttgattttggtgatgatataatgggtatatgcatatttttaaactaatcaaattgtatatatttaatatgtgcagttcatgtgtatcaattatatatcaataaagctaaataatacaatggaaaattcagaataagacagagatggattgtgaaataatgttcatacattgtgttagtttttcttaggctcaaattggtgctaatttttttttattctgagagataaaaagctgaaggtttcagaatatcactaatgttttatatgtagttctgaagatttgtacaaacctctcttccccctttttaactttatataaaaaaggagaaagatcaatctgtcggtatgagaaaggaaaattataagttctatctggggatttactcgtcattaagtttgtatttcaatattgcaaaaaactcttggctatgattagagatattcatattaaaaattcagataatgtagactgttatgaagaagaagtttcaaattagctgaaataagtttcaaagtcagttaatttgttaccagcgggagaaagtcaccattatatttggcgtgtattcctgaagagcatacataagatagacataaacacaactacaatattggaaggtttgcttatttattttatagaaataatcattctgtataaaatttgagaagtgcttctttcttacagtttatcatgaccatttttctattatgatggttgccagggactgcgtgaggagaaaaatggaaaattatttttcaatgggtataaagtttctgttatgcataataaataagttctgaatatctgatgtgtaacatagtatctatattaataagacagtattgtgcactttaaaatcatggtagacatgatttattgtagattatacattttcccatcctaagaaatgcatagtttttgcttccattggcattaaataataattatgtataaggaataaatttaacataaacctcttttatttgcttattcaaatttatttaaaaatttgaatgtttgtacaaacctaaaagtagataaagtgagaagaatagcagccataaattttctcagaaaattacatgaaaacctaattaacagctggtgataacaatggtgaaactaacttcccaagattttaaaatcagtcatttaaaacttacactgtcaaacatcaagttcaatattcattttagtatgcgactctgcaatcgacaaaaatacatttcttttaatttatgaaacagaaaatatggttgttttctctatttcttctcttaagacattatttaatcatctgtatctttcttttattgatctcttccttttaaaatcttcattactcttgtcttttctcccagctagtccacttgctctgctttatcctgttatgatcttcttctaatgctcaaccaccattccaaaagggcttcttcataatttaaattaataatgtgagtgtgtgtagaaaaaaaagcgtagaagttttattttaatgtttttgagcaacctaaatgcgtggaagatgcatcatcacgcaattttaaaaataaaaatgatagattgatatattttaatttgtattacatgctatctgcttatgttcttcacatgttaatggctactgaaaataaaaaccattacaaaattctcttgaagcctttaaacagaagaaacaaccttgtaaaaataaatatttgtctatgtgtctgaagagaaccttcttccacagctgtgtggaagaaccttccacagagcataggtacatgttgcccttttttcaatatttaagatgttatatgtcatatttaaattgttgtagtattccaagacagtaaaactagtgatatatttaatgtgacaataatgtgttaatttttatttcaagacatcttgtatgaactactatttttgggaagaattcacctgccctggattgctatgctctatttggaagtacatatccaaatatcagtcatttatctctattcctaaagtctagtaaatgcaacaagcaatctgaaaaagagaactgcagctgcataaaatgagcataattgattactaattgatatgcatctaatagagacttctttctacccctttagtatctttttatttattttgaataatgttttcatgtttggcccatttccttgttctttctccaccccaatctcccttatttatttaggtcaacttgacaaccccttttttttttgagaatgaattcgatgtcttaaaatctctctctctttttatatttattttagtttggcagcaaacattagttctcgcttgctatattttactcatcaaagtgttaacatcattcataaattattaccaatggtaggcactggttgttatcaatcaccagggaataattgatgctgattgaatcaaataaatgtggtgtttgtgaaactatgaccttgtcattcaacttgggtacaaaaatctattagatctatgagaactgaatcttaaagataactgaagaaggcagctttctattgacttaaacaaataaaaatgtctttttatttgaatatttctttctttacaatacatgatagtctaaagctctgaaaaacaacaataaaatcactactaatctcccttatgtgagactaaatgaagggtcctgggaatattaattctgaaagaaagcttgtccagcctcccattttataataaactatatcaattcaaggactacacagagtaaattttttcaagttgtatagttctctggtttgaaagtgtcccccaaagtttatgtgttggaaacttaatcccgaagcaccagtgttgagaagtgggacctttcagaggcagagccctcatgaatggcaggattaatgccattattattgagtgggttagttatcatgagagcagattcctgataaaacggtaagttcagcctccttccctctctcactcttgtcttctcttgcctttccacctaaagccaggagatgacttagcaagaaggcctgcatcagatgctggcaccatgctctcatacttcccaacctccataaccataagtcaatacatttctgttctttataaattacctagtctcagatattctggtatagcagcacaagtgaactaagacacatagtgagcctttagcagaaccccattttcctaccaacctctcatgtcacctcccacaatgtgcattttcttttatttatactaaaagtgaccaaaaaaaaaagtttagaattgaaactatttccagttggtatcaagatccagatagagttaaccttaatatatatgtgtaaaaagctacaattcaaccgagtctctaaggcttcaaatatgaaaagaaataaaatgtgtttgttgttttgatttagccacaaatcagtgatttaatttagctactcttttccaaatgactatgaatttgatactgagtcagtgctttcatggtatgtccataggtgtaaaatgatggccttaatgcttataataataaggtaggtttttgtatgtctaatatacagagaaatttccaaagactttttaatctttgcttagcataaggagtttagtcagtaactattacaaggaaaaaatgatcagttttcatttgtcagttctataagccccaggcaagtttctttcggttttgactttttattaattaaccatatcctaagtgctaaaagccatgagtcatttttaaaatttatctttttttgtatgccatcacttctagttttaccactttgtactcacaaagaagccacaaatggattaatcattatgtcatctaaggaaataaatccatggcataggggtaaatttaaaaaatactttgtactaggattttataatagcttaaatttattgaagggctactgtgtcacaatcaacatgctcagcatttttcatgtgttattttccatttgtaactggcaactacttaggattatttagttaaaatcccttcctttatggaatgagatgtctgtttattacgtttacagccacattacagatctattgacataaactccaactatggtaattgttgctcctttttttccccctctctgtttcacctgctcaatgtttaacataatcaaggtgaacttttttagagaggcttgcttcatttttcacattgctatgaccattcctacagtcattgtcaaatgcagtcataaatcaaatatctggacataggagtttaggctaagtaagttacaaagttgttttggcgtccaaaacttaattgtataaatatctccaggggatggagatttctcccctgaaaatagagcacttggaacagaaattcagattgcttatttcatataatacaaattccttataaaacaactctttaatctacttaaaatccaatagcccattaaaattatcatcttatcttagaccccattataattcttgtctcattccttcctttcattctctctgtctggcttttttttttttttttttttttttgctaatttttattttcttaattgcattgcatggatgtgtacattttgtttattctgttttgctttgctctgatcatgagggtctttatacttggaaataacaaagtgtaacttaaaaatacaaatatactttttgtgccacatttagagaccaaattcttgattaattattggatcaacatgagttctgggataattcttaaaaacttagtgtgtcatcatgagaaaatcaaggataaccattatcagaagtaaatgtgcaaccagttaaaaattcatatattataggccctaattttatttctctgtccacccaggctggagtgcagtggcgtgatctcggctcactgcaaactctgcctcctgggttcaagtaattctctgcctcagcctcccgagtagctgggattacaggtgcccaccaccccacccagctaattttttgtatttttagtagggaccaggtttcaccatcttggccaggctgatcttgaactcctgaccttgtgatccacccgcctcagcctcccaaagcactgggattacaggcgtgagccaccgcgaccagcctgaaatatattttaatttggttttgcacatcattaaattggtttcccatcatctttgactagcctttctatagttcctgtatttctaagttctcaacatggaaatcaactagttaggatacaggccggtcacctagactaccaatcatctgaacttgatttggaattgatcagtaagaaaaagcaggctccctgcagtgcttctaagttttgttaggtgaatggtcacaggatattttgttttcgctggcatcagttgttgtgagtgaagttcctagcatagaagtggcttttgtagtcctgaagcaggtagacattttctataaaggctctatggagtagaagttattgtttcaacagccagtttcatggtgtggtttcagccaacattcctagaagcttagccctgatctgggttttttagttctcccaataaatttatcagctgcccacacctttcattttttgccttcagttttattgtgctataattgacaattaaaatttcatatatttaagatgtgcaagttaatgatttgatggacattatgaaacactcaattaccacaattaagcttattaacttctatcacctcctgtagttactatcatctatttttgtgtgataagaatagttaagatctatcctcttagcacatttcaagtatataaaacagtatcaactatagtcatagtgttgtgcattaggtctctagaacttacccatctcacagaattaaaattttatgccctctgactgagagcttctcatttccccctcccctcagctccttggcaaccaccattctactttctgcttctatatgtttgatgattttagtctccatatataagtgagatcctagagtatttttctttgtgtgtttggtttattttactaagcttaatgaccttcaggtttatccattttgttgcaaatgaaattatgttcttcttttttaaaaattaacattttgttgcatttataaaccacaccttctttatccatccatccactgcaagacattttagttgtttccatattgtggctacttagtgaataatgctgaaatgaacacagttgtgcatagatctcttaaggaccctgattttgtatcctttgaaaatgtgccaagaatcaaggttgttgtatcataagatagctctatttttatttttgttttttattttttttttttagcaacttctgtattgttttctataatggtcataccaattcacatttctcaaaagaaacatacaaatagcaaacgggtatatgaaaaggagctaaaatgaactaatcatcaggaaaatgcaaatcaaaaccacactgaaatatcacctcatacctgttagcttggtcattatgagaaagaaaaaaggtaagtgttagcaaggatatggagaaaaggaaacccttgtacactgttggtagaaatgtaaattgttacacccagtatcttttttaatacactccctttagctttaattaggtaaaatccaatattgttgcttgtagtcaagaattctggtatggccttcctcaaactgttattcaattaaaggacacccgaagatatatgaacatagaatgatgtatgtaatatatatagaagtcaagaaattctagcttaggtcctggctccaatgtgttcttactgtatttgagcaaatcaattaaattttggcacttcacttttcttgcatgtagaattgttttgagaagagaaatttttattttttattttatctttttttacaatttttgtgggtacatactaggtgtatatatttggggggcacatgagatgttttgatacaagcatgcggtgtgaaataagcacatcatggaaaattgagcatccatcccctcaagcatttatcctttgagttacaaacaatccaattacattatttattttaaaataatgaaaaaaatgcaatgttttaaatttctttttgttcttctcagtattttttaaaattcttgagccaaggatatatatttcatatttaaaagatgacttcttattcttgatgcctatattcttcagcaatgtataataagatcaaatgaaaaccaataattaaatgtcactactgttcttgtgtgcctaatgcatatgcattccattgtttcatggtattcgggtctgttttccttgcacaacttttcattgcgctagtcttgacttttttctgtcaaggaagacatctttaaaaggtacatagacactttataaaaagttgttccttctgggcacttatgtccataggcgaactgcttagcaaaggctcagtggcttgctgtattctggtagaatacagccctgtgcaagaatatagccagagtatagattgacattcggccacctcttattctctaagctgagttgttttgtgtagagaacaaatcacacaatcatatgaagaaggcttcttatatctacatataatacatacaggctgggcgcggtggctcacgcctgtaatcccagcactttgggaggctgaggcaggcggatcacgaggtcgggaggtccagagcagcctgatcaacatggtgaaaacccgtctccactcaaaatacaaaaattagccgggtgtggtggcgtgcacctgcaatcccagctactcgggaggctgaggcaggagaattgcttgaacccgggaggcagaggttgcagtgagccgagatcgtgccattgcactccagcctgtgtgacagagcgagactccatctcaataataataataataataataatattacatacatatatgtatttatctacattcacactttatatcagtgatgatattaaaattagacatttaaattaagtttggtaagtcatttcattttactagaatttaaattactgcctacttcttacaatttaaatatgttaagagactttggaaataattggaattcactaataactttatactgaaaaacattttcaatttgcccaaattgtatactaatgaatataatacataaggtaccaaaaaagtatacttaagaattacaaataattaccaatgttataaaatactatcaaatattgattacaaatttttcaaatttttggttcatcagcagggaaaatttttatcctctggaaaatctaagtatggatatgggttaaggtcctgaattttattattattctcactatcagttgttgtaatatttagaaactataattaacaataatgcttaatgtatatctcccacttttttattgttcctagtactatattgagaaaaaaaaaactaataataaaatgggggcaagtactggggatttctctgtcaagcaaggaaatgcttttctcaagaaaaatctggaagcttgtcagtagaatgtgagaaaggaaagacagttggtatttagctgctgagctcaccacctcctgtgcttattacattcttaattgtttctctcttaccccaactgggttcatgatgcaggaccaaggatgtcaaagtagcactagtattttcagagcagtgcattagggcaacctaatgcctgatctttccatcctaatcttaaaaatgctcaaaccccatgtctaagcttttgctgttcaacacatcgccactagtcacatgtggccattcatatttacattcacattaaataaaattatatattcagtctgtcagttgtactagccatgtctcaagtgctctagtcgcctatggctatggctacgatatagggcagcacacactgaacatttatatcattgagggaagttctattaagagtcctgacctagcacttacttaaatgctaatttgtatttttaacttacagttccctggcatcttgcttgaaatactctggtgacatagtaaaggtctcattcccatactgaatgtgttctttccatttaatagttgccactaggtaattagtagtgtctcatgggatgacagacagcagagcacagcagtcacaatgttaccgtgttttagcctgtaaaccttttgacaaaggcacatgttcctttatcacaacttgtttgtcaaagtagagtaattaacatattgcatccaatctgagataccatcaattgaaagatataccattattttgtattttcatgaacaattaaattaatgacattccgtttggtctacagtctgcccaattccagagatgttaaagtgtgaaaaaagtgtgcaccttaggtttattgaaatttaaaataagaagccaaacttttactcatttccaaaattgaatcttattgcaacatacagaaaatgaagcaacttaaatatagaaaaccttgcttgttagtgtttcaatggattgagaggcttcttaaaatacttctctattcctttattcattttatgtatcttgctatattttaccccactctaactctcttgcttttgggtgttcagttacacatacgttagaatattttatattgctccaaacttttttcctaatacttcttctctttgtattttaatttgagtaatttccactaacctatcttcaagcttaccatttttttaatggtgatatcgaatctactaccaatcagtggcaatttatatttctgttttttattttttccatttccagcatttcttttttttaatttcttttttataaattgtttattttaggtttggggtacatgtacaggtttgttttatgggtaaattgtgtgtcacaggagtttggcatatagattatttcatcacccaggtaataagcatagtacccaacaggtagtttttttagtcctctccctcctcccatcctccaccctcaagtagaccttggtttgttccctttgttgtgtgcatgtgtactcagtgttcagtttccctcataagtgagaacatccagtatttggttttccgtttctacattagttcatttaggattgttttagtccattttcatgctgctatgaagcatatctgagactgggtaacttataaaggaaaggggtttaattgattcacagttatgcatggctggagagttctcaggaaacttacaatcatggtggaaggcaaaagggaagcaggcaccttcttcacagcgctgcaagaaagaaccaacaggggaaaccctcacttgtaaaatcatcagatctcatgagaactcgctcactatcacgagaacatcatggaagaaaaccacccccatgatccaataatctcccaccaggaccctcccttaacacctggggaattgcaattcaagatgagaagtgggtggcaacacaaagccaaacatatcaaaggttatggcctccagctatatccatgatgctgcaaaggacataatctcattctattttatggctgtttagtagtccatggtatgtatgtaccacattttctttgtttagtctcctgatgatgggcatttaggttgattccacgactttgctattgggaatagtgttgtgatgaacagacgtgttcctctgtctttatggttgaacaatttataatcttttgggtatataatgaataatgggattgctgggtcaaatggtagttctttcaggttctttgaaaaatcactaaattgcctcccacagtgtctgaactcaattacattcttaccaacagtgtataagcgttcacttttctctgcaaactcaccagcagcagttattttttgactttttagtaatagccattctgactggtatgagatgactggaagaaggtacctgcttcccttttgcctttcaccatgattgtaagtttcctgagacctctccagccatgcataactgtgaatcaattaaacctctttaccatctcattgttatatttgcttttctctaatgattagtgatgttgagcgtattttcatgtttgttagccatttgtgttttttctttcaaaaagtgtttgttcatgtcctttgcttaatttttaatatggttatttgtttttacttgttgatttgtttaagttccttatagattctggatattagaactttgtcagatgcataaattataaatactttctccagtctgtaggttgtttgtgtgtgaatagtttctttcactgtgcagaaactcttcagtttaattaaatctcacttgtcaattttcatttttgttgcaattgcttttggtattttcatacaatcttttccagtttctatgtccagaatagtatttcctaggttattttccaggatttttatagtttcagggttttcatttaactctttaatccatcttgagttggtttttgtatgtggtaaagaaagggtacagtttcattcttctccaaatgtcttgccacttatcccagcaccatttattaaaaagggagtcctttccccattgcttgtttttgttgactttgtcacaagattatagttgtgcagctttatttttgttttcttttacgtgttccattggtctatgtgtctgtttctgtaccagtcccatgccattttggttactgcagccttacagtgtagtttaaagttgggtaatatgatgcctacagctttgttctttttgctttatttctagcacttttatttccttctttcttatattatattatattcttttatttcattctgctgccatttcccatctaatcatgcatatgtcccaacttgtccactagattctttaacatagtaatcatctatatattaaatttcacaggtgggaattttaatatacagatgattaatatgttaaatatatgtgtcatatataagcttagttctattgttttatcttttgacagtgtattatttattttacttgcatctttgtgtatcttataattttggttagaagccatatatcttcagtacagtagtagaaacttattaaattgtttatatactttatccagaaattaccttttttttggtaagccctttattatagggagttgtgccaatattcaggtgctgagtgctatggtttgaatgttcccgccaacattgatgttgaaatttaattgccattttaacagtgtggagaagtgggacctttaagagatgattaggtcacaagggctccacttttataagtgaattaatgccattattgagaaagtgtgctcttgataaaagcatgaatttggcttcacttttctctctgtcttacatgctcattcaccatgtgatgccttccacaatggaacaaaccccaccagattctggtgtcatgttcttgaatttcccagaccccaggagcatgagccaaataaacttctatttgttataagttatccaggctgtggtaccctattatagcagcagaaaataaattaagacactgagtttctggtttgctgcttctggtcactctcagttcaccacaggcttccaaactctctgatttaccttatgtttaaagggtgggctggtctgtcaggtagtttctctcgatgtctcatccactctcaaattcagatctcccatgtgcacttctgtctcagagaaggtcgttctttccacactcttataattccccctggctgtagactgttttgtattactcaacactttctagcctagtgttggcagaaagggaggatgacatttttcatttttctgttttactatcagccttaggtaggaaagtatgtcatgagttttgagggtagaacccaatatgaaaatcctactgttcttttatcagtataaacttatttaataatctgtgcccagaatgtatttcaggccttcccttaggattttttttcttctatttctcctgagggtagaagtatttgctgctattttgcaagtggtataaagcttttgttctacagtaaatatagaaaaggatctggtttcttagactaggggaatatgtgttattgttactgttattgagtaggacattgtaacaaatgtaatctattgctgatgggaatgctattagcaaaaggtgtacatttggttttggctatcagttgagaagtaatctatagcaaataagtaaataaaagcatgatgttttattgtatttaagtgtttaaggtcaatagcttgatcttcagagataaaactaaaactcactattgaagagcatgaactagacagtcagattagttgtgtactgtagttaatagaaaggataagaatgcaaacgggaaaaattaaagtcaattcttagtcttcctgcgttaatttaaattgtgtttgcaagtgatttaaatactttcccaaaatgtcttaaggaaaacgacttaaatggttcatatagtcagaaagttcccaggtagttctagctcccattgtgacttaataatacatatctttatttatttttcttggtttctttttccatcattttggtcacacttaagacagatattctctgtggtggcaaaattgctccagtaatgtcccacgtctttccagatgaaagtgcagccagaaataatgtttgcttctgttccagatttgttatcaaacattgcatgatgcttattagctctgagtagttacatagccattgtatcagtcattgccaccatagcataatcaagcctctgacatggtatccctggcatctgagaagagccagattccttctaaacacattgacaaagagtgaaagaaaactatattccaaaacaatattagacatttttaggagaaatagaattaactgatgccagttgtctgttttagtcaattgggggtgctataacaaattaccacagatgggtagcttaagtaccagacatttatttctcatagttctgcaggctgggaagtctgaggtcaaggttctggaagatctggtatctggagagggtctgccttttggttttcagatgcagtcttctcattggatcttcacataacagagatcagagaataagcacactttcttgtttctcttataagggcactaatcccatcataagggcttccagctttatgatctaattatctctcaaaggccccatatccaaatatcatcacattggggattagggttttaacatataaatttggatggagaggacacaacattttgtccacagaagtggccaaaaaaacaaaaatgactattgtattcaaagatcattgatagttttcatttacttgatatttcagaaactcattttctcatccttttctagtattcatgtttctctagaattcaaagacatactggtctaatattaaactgtgttcaccatgccaatttaccccagtttttgtaagctttttatcttaggttcagtctaagagtaaaaagcattgtcttttattgtaggttgcaattttgagaggctaagttgtgaaagagcagaaatgtgactacgtttagaatcttcttttgcaactaactttacttttaagctgttttatgctgagatatatacctaccacttaaaatatctcaatcaaagtctacgttaaagctgccattctcaaataaggactatgtattcatttgtcatttaaaatatattctatcatgtaatcctttcagtcaattcatggggaagataatattgtctacttgatgctgacattgctctgatcccaatgataggccaaataaaagttagattaaaaggcatctccctctgacttcaaaatttttgctaattttaatgtaatatgatatgtggatgaacaggcaaaaaattgagtcacatgagttttcatgttttagagaaactattggaaaaaaattgttaagccatgtttgagaaataaagaatattcctggtttctaatattatacaaacctcagttgattattttaaactagtgatgatattcagggcatgtctaaaaaaacactgggagtataactgtgttcatggttgatataattaattttgattcctgttttcattgttcataaaattataattttcaaagtatttgaattctaaatgttctgttttatccagtttttctttttaaattcatataggtttttaactgggtaaatgagtaagaaaaatatatacatttaatatttgagttctggtcttaaaataactataacagttttataaaccaagatgatattttaatttaattatttaaaaaatatattttttggtttgcattgacttactaaatagatttgcagttcagaataaatcataagtaaatgttctaacttgaactaggacttaaataaaaaattaaattaattcaaagttttcattcaaagtctagttttgtgctagttcatttggtagcttttagcctcaaatagctattgagcactggtagcatggctagtgctacattttgaaataacaatattttagatatgttacattaaataaaatatattattaaaataaattacagctgtttattttcagttttaatgtgactgctagaaaatttataactataattgtagcttgcattctattagacagcactgactagatcaatctgcagatctagaaatttagaaagccctttagattttaaatcttctaaaccgatgcctacaaaacaccaatatttaaaatcattttctttctcttagctaaccagcagctttgtgagaatttttattcagcatttctagagaccagcagctttgtgagaatttttattcagcatttctagagaatgctgaagtcactgaatctcaccacttgtgccccatctgtatttatgcaaatggaatagtgtgacaactgatatgtaaaacaatatattttattatgtgcatattctgttattcatagtgtattcaaaaccacttataaggcaaaagaactggtagatgagattgtctaccatcatatactcagtattgacagctgagaacagttttcagtagtagaaatatgtgcattttcttgagcataactagtggaatgttgaaaaagtagtactcattgaggaattatgccctgtatttgaaaatcttttagttattccattatagaccttggtgtgcttttgaggtgctcttgaagtgataaagtctttgttatgttggttggttggctggttggatggttaattaatttggtatcttggtgtcatatttcattagcagacacacttgtacaaaatactctatttttttttcctatgacctaatcaggtcattttgtttgtgcatcaagaggcatgatacccatttcatgtaaatcatttctagatagttagaacataactgtaaaaaatattgaaaatgaaggacaagggcaagaaaaaaatgagctctttaggaattagaacaattattattttcctacagatagcctaagaaaatgatgcacagttaaaagagactaactacaacatttaaaaatttttatcttgtccctgatgctttcgtttccttccttgattgattgtcatcatggcgccccttctttctttctttctttctttctctctctctttctttctttctttctctctttctttctctttctttctttctttctttctttctttctctttctttctctttctctctttctctctctctctctttctttctctttttattgagacaaagtctcactttgtcacccaggctggagtgcagtggcctgatcttggttcactgcaacctccgccacctgggttcaagtgattctcatgcctcagcctcctgagtagctgggactacatgcaagtgccaccacacctggctaagttttttgtatttttagtagagactgggttgcaccacgctggccaggctggtctcaaactcctgacctcaggtgatccgcctgtcttggcctcccaaagtgctgggattacaggtgtaagccactgcgcccgactatcatggcttatattttaaaaagtagttatgcagttatatataacaattaaaaccctcgcctacatagcttaatatgagtctctggaaaattttttcctctactctctctccaaaacagaacaatcattaatgatatagtttgggatttaattgatatcctttgttatactgtatttccaatgcagccaaatgcgattttattattcagctggctatcttttattcaatgtcaggatgagttaatcactttctttctaatagttaccacatatcagtgagttaatgtcatgatgaatatatccagaaaggaataacataggctaaaatagaatattataagaaatattctctatctgcctgtttcacttcaagtattataatattgaatgcaattgctaattaaaagtttagggagtcaagacatgcctaagagtacccagataattgacctagataatcctaataacaagttaggtgccttaaccaagtcattgaaagaatcgtatttcttctgtccagtcgtgtgtcagccactagttgttaaatatctcctgatacatttcttaattcctcactctgtttcctaaactgttcggtatgtaattgttacctggactctaaagtttctttttgtatggactaggtgtgatatttcaaacctgtgctttttactcatattttgggttctgactgtgatatagcactgggaggagattgtaaaacatctgttgagagtcactgccttatctatagtctgaactaaaaatgtctctcttcagatgactccaagagttcatatatttataaattgtatctaatgatttttatgattcggaaaatttgaagaacgtcagagtacactttaaaaatggaggaaagtggccaggcatggtggctgacgcctgtaatcccagcactttgggagaccaaggcgggtggatcacctgaggtcaggagttcgagaccagcctgaccaacaaggagaaactctgtctctacaaacaaaacaaaacaaaacaaaacaaactagctgggcatggtgacgcttgcctgtaatcccagctacttgggaggctaaggcaggagaatcgcttgaacctgggaggcagaggttgcagtgagccgagatcatgccattgcactccagtctgggcaacaagaacaaaactccatctcacaaaaaaataaatgagtaaataaataaataaataaataaataaaggaggaaaggaaaatttggagtcataaaatcagttttctagtgtcaacatggcttttggaatcaagcacaagtgggcacagaaataaagaaaacaggcctacatacttcatgatgtttttttttttttaagatttttttcttatttttcttatttttgctgtaaatcgtatgtactctctccaccttgccggcagttacatgcttgtgacatgtatccttcctaagagggaaaaaatgttaattactgaacctcagattctgatgcctggtctgatttatagtttatgggtgatgtgtttggcattttcaaggctcagttggttttgttgagcttcaggactgaagacttggtcccttaaagaagaacattctgcttttagtaataaccaggttaatgtgggccacatgccagtccagctgaatatgcatgaagtgattgaaattgaaagtcagttccttacatgtttgagtttcatgctatgaggaaccttacaaatagaggtcagagggatttttatgttgaaaatcagtagagtgttacctttgctatggaagaaaacaactttcttccgatattaatgtcagcattagagtaattgctctgtgaaactctgtctctagagttccattctctcttgaacaacaaatctttatcatcaccttagtattcaggtcatttttcataagtagcacataaagaacacattaatctttatagatgtctgcctatatttttatctcaaggttagttattgtcaaatattgtcaacccacagccttttcctttgccaagagttctctattaactcctccaataacctcccatcttttaaaataaaaacattgattttccctcaaagatgttatcattacctggaaactgaggcaaacaaagttaagtcatgtgttcaagttttcagtgtaaatgctgaaccagacacacaatccacacatatattttaatccacaaactcactattaaagttataatgcagactttgacgaatatgacgagcaacatattaattaaaaacctgaacaagtaaataatgttcatgaccaatataaatggatgctttaaaaaaaaatgactcaaacagatgtcatcaagatggcttactagaagcctctagcactcacctcctccacaaagaagaaccataacagcaaaccacacacattgaataggatgtttaagggagaacaatgaaattcagcaaggaagtgatgaagaccatctgaggcatggaagcttgagatggtagcatagagagggaagcaaagaatctggccaagattggctcagagccaagaggtactccccatttctgagaataggtgagtggggaatgccccaaagcccacattttgacaacagatacctgcaattctagctatagtagagcccctcaggcctcataggccctaagttcaccagagggagttgcctggagttcataggattttattatcccagagaaaaaaaattaatgctagatcaccttcactcgttgggacccaggttattgcagcacaatgacattttgagagcatggtcaccatcagagtacatccttccctgaggacgaatagcccctgcatttccacatccctggggcctgacatccatcccacatccattcagagggttgcagtgttgcgccaccagctggacccaatagttcagctgtgactgttgtactgaagcacatgcaggaccctccatcctagagtataaatagtctagcacagtgaggaagctttcccccggacggagaaagctgacatgcatattccccagagccttcaagccaccagttcaaggcataacaccacaaccagcaattacatttactccagcagcagagatgccatgaacttgtgcatttacttgaagggtctgaaggctggtctgcctggtatccccacctctgagcaaacttgtgccatggcaaataatcacagaatggccacaaaggcacttagagacactgctgacattgattaccaaataatttttatagagactatattactgtgcccactcagaaccaaagccaaagtattttatccaagtaaaactgtaggacacacatagagaaaaagatctttccctataaaagctacttcataaaactggaagaagagattgttccaccagatgcacagatattaacataggaataccaaaaaaaatatgatttagaaattcaataaaaagatagctgtattaaaaaagaaccaaacagacatattaaaattgaaaaattaaataaatacaataaaaataagtgcttcatcaatagactaaattaagtagaagaaagaatttctgaacttacagacaggccttttgagataaatgcattagccaaaagaggaaaaagaataaaaatgaatgaagcaggactacgggacgtataagaggacattaagaaaacaaatattggaatcatggaagttccacattaagcagagaagaagaaaaacatagaaaacctgtttaatgatgtaatagctgaaaactcaattcttggaagatgtgtggcatgcagataacaagctcaaatatttccatgtagatttaacccaaaaatgtcctctctgaagtacaataaataactatcacaagataaagagagacttctaaaaacagcaagaggaaagcatcaagacacctatgaggaaatgtcaatcagagaaacggtaaatttgttagtggaaactatacagatcaggaaataatatgataatatagtcaaaattcagggaaaaacagacaaattaccttccagccagaaatataacactcaggcaaaactatcctttagaaattaaggagaaataaagtgtttcccaggcaagcaaaaattgagggaattcatcaccactagactggtcctacaagaatgcttaagaaagtcttacatttgaaagcacatgggcaatctctaccattataaaaacatataaaaatgtgaacctcactggtagaacagataaataaatgagaaataaaacagaatcaagttaaatcaatatagaaaatcaacaaactgcaaagataagcaataagagaggaagaaagaaacaaagaatttgtaaaacactagaaaacaatgtaaaaaatgataggagtaagtttttcccagtcaataactgactagcatgtaaatgatttaaattccccaataaaaagatacagaatggctgaatcgattaaaaaacaagactcaactatatgctgcccacaagagactcacttcatttgtaaggatacatgtagactgaaagtgaagagatggaaaaagatatttcatacaaatggaaataaaaagtgagcaggaaagctatatttatatcagataaaatagactttaagtaacaaaaaaagaaacaaagaaggttattgtgtaataataacaagatcaattaagcaagaggatataacaatgttaaatatgtatgtacccaataccatagcatccagatttacaaagcaaatattgttagaactaaggggagagagagtctccactacagtaaaagctggggactttaacgcctgactctaagcatgaaacatatcatctagacagagagtcaagaaacataggtcttaaactgcacttaacaccaaatagacctaaaaggcatttataagtcattttatcctttagctgcagaagacacattcttctcattagcacataaaatattatttagcattaattatacttagagccaaaaacaagtctcaatatatttttgaaaactcaaaattatatcaagtaagaggaagcagagcataaaactttagaaaattttcagtctgatgatgcaatagaaaagaaaaacccattttctgaagagaaattcaagccagctgcagaaatttgcataagtaatggggagccaaatgttaatcaccaaggcaatggggaaaatgtctttaggcatgtcagagcccttcacggcatccccgcctgtcacaggcctggaggcttaggaggaaaaaatggtttcatgggccaggcccggggcccccctgctgtgtgcagccttgggacttggtgccctactttccagctgctcctgccatgctaaaaggggccgcggcacagctctggccattgcttcaggtgcaagcacccagtcttggcagcttgccttgcacatgatgttagtcctgcaggtgttcataagataagaattgaggtttgggaacctctgcctagatttcagaggatgtatgggaacacctggatgtccagcagaagtctactgcaggggtgcagtcctcatggagaacctctactagggcaatgcagaaggaaaatgtagggttggagccctacacagagtccccactagggcattgcccagtggagctgtgagaagagggccactgtcctccagaccccagaatgttacatccactgacagcttgcaccgtgcacctggaaaagctgcaggcactcaacaccagcccatgaaagcatctgactgggggctctactctaaagccacagtgggtggagatgcccaaggttgtgggagcccacctcttgcatcagcatgccctgaatgtgggccatggagtcaaaacagatcattttggaactttaaggtttaatgaatgccctcttggattttggacttgcatggggcctggagcccctttgttctggccagtttctcccatttgaaatagttgtatttacccagtgcctatacccccattatatctaggaagtaactaatttgcttttgattttacaggcttataggcaaaagggacttgccttgtctcagatgagactttggactatggaattttgagttaatgctggaatgagttaagactttggaggattgttggaagggcatgattgtgttttaaaatgtgaggacatgagatgtggggggggtgcatgggtggaatgatatgatttggctgtgtcccccacccaaatcttgtcttgaattgtagttcccataatccctacatgtcataggagggacctgatgggaggtaattgaatcatgggagcagttaccttcatgctgttctcatgatagtaagttctcaggagatctgatggttttatagatggtttcaccccctttgctcagcactcttctctctttctgacttgtgaaggacatgtttgcttccctttccaccatgtttgtaagtttcctgaggccttcccagccatttggaactgtgagtcaattaaacctcttttctttgtaaattaccaagtctcagatatttcttcatagaagtgtgagaatgaatagtatggaatcattgtaagtgtccatcaccagctgaatgaattaaaaaattgtggtataaatatacaagggaataatatgcagctattacaaaataataaaattctgttatttgcatcaacatggataaacctggaagacattatattaagtgaaataaattaggcacaaaaagataaataccatgtgtatcacttgtacgtgggaacaaaaacatttagctcacagaagtaaagagaagaactgtggttattagaggcttgaaaatgtaggagtaagagaagatagaaagaggtttcataaaggatataaaattatagctagaaaaaagaaggagtcctagaattctatactacctcgggcaactatagttaacaataatttaatatatattttcaaaaatcctaaagagaggattttgaatggtcacaacacaaagaaataataaatgttttaggtgatgagtatgctaattacacagatttaatcattacatattatatacatgtataaaaatatcacattgtattccccaaaatatgtacaattttatgtcactcaaaaattttaaaattttctaaatgacaagaatattttaaagatctctaagtaaaaagttttaaaacatttttaaataaaatttttattcaacaatatttaatatgcttctcagtttaactagaatttaataagaataagatgttttaagtagtcaatatttagagtgtgtatatgtaaccaaaatatgaaaatgtattagtattctttacaattaaatgtgttttaaaggtgcaatataatccttgtaaggaaaaggcaaacaaataaataagtccacaattgaccagtaaaagacaaattatgtatagaatgtaagtataacattcaaataaagaaaaatgacaaattacagaacaaattgcattgagcaactttctggttacttggggaataaaaaacaaaagtggatgtatacctcacaccgtaaataaaaaataattattgcttaatgaagagatcataaattttaaaagtactagaagaaaaaagtgtgtgagaacttacaatgttaagctagttaagctacttttggcatgctacttaagtatgagaccataaaggaactaacttttagagtaaacatataaagttttaaaaattatctgtggaaaacacacaaaatgaaaacacagatgctaaatagggtaaaatgtttactacatacataaaaacaaagttataatctgtcatataaaaagagcttttagagatcaataagaaaaagatgaatgaattcccaagaacaaacaggaaaaagacactgatatataagttatgaatgaagaaacacaagtgattacagcttatgacaggatattcaagctcaatcataaactacaggtctaaatgatttgttgttgttgttgctgctgtcattgtcattgtttttccttgaaataatttaaattacctcaatggcaacatgattttattgtgactttgaacaaagagagagatgcttgtgtagcatgtaggactataaattgttttagccgtagtaaaaaatgactggtaataggaatcaaaatgtaaaatgtgcatatcttctgatctacacattttacttttgagaatatatcctaagcgtatgcaaaatatgtaataaaaataattttagagttttttatggtatatggaaaatatgaacaatctaaatagctattaataggtaaatacatatattataatacttggaatttatatttattaccatttttctaatatttaaaaaatcatttaacacaggtatgttaattatgtatgagggtatagtgttatgcaaagttacaaatacaaaatcaatacaactcattttaaggattttctatctctgcttggtagtaaaacttttatggaataagttaacaagttgcaattgaaatagatttgagcttttctggttgtaatctcttgggcttagcctcaggtaataaccaaaaaatttccatatatttttgtcctttaatcctcataataaaacatttggatatatattattttctctattcccttgatgagtgaattgtggtttttttcccctttctttcttttccttccttcctgccttcctaccttccttcctttccttccttcctttcttcctttctctctctctctctttctctttctccttctctctctttctttctttctttctcttccttccttccttccttccttccttctttcttcctctttctttctttttcttttttcttgtaaactgctaaggaaaacacaagctaagatttgatcctattgaaatgaagacaaccttttctccaaagctgcttggaaatgaaatgaccacttttcgaagtcatggtttattcagttaacaagggcttgtaatttcctatgtgttgaaacaataattttcatccttacaattctagttccagcactaaatggaagctaggttgggagtttggctctctgtcctattgcaatatatttatttctgcatggatatgctagagagaaaactagtttatagctagtgagacaatgtttaaacttatttcgctataaatgaaaaatcgcttgtactactttcagtaattgattttaaatgccattcaggttatcaaaccagatattttcaaatgatgataagtagaaaatagtttaatgccaactgatgtggaagttgcttatttgtgttaattaatgaggagaggtctggtccatgaaaatattgtattacaaacagtggcattgtcaatgaggctgttagtttactcaagagtgtagtatggtgaaagttacatgttaaatatcaattactgaaaaatggaacatctttgaaaaggaattttgcactatagaaaacgtcgcaggaactctaagagcaattctaagagcaatttaaagaaggtttttctataatataataagcttatttatataacagggaatatatcagaaaatgatttattctgcctgctcaaagatctcctttggggtaataaagtataatcttctggtattagctgctattaatacataggccagttgaattatatcctaggcagaatagccctacatgcaattgaaaaatgttgtccaggtgatttttggtatgcttttaatatttgagtcatcagccatccattgtctaaagtaaaataaatatatcaaataaaaacgtgtacttcattcatctcattaggttgtcagcatttacagttagagagtatttctgaaagtattgtatttcagttcagaggaaatacactataaattataaaattgctgacacagtatctaattcttttccactgtgatgcctactagacccaaataaaccaaagaaaagtataaatagtactttattatacatcttgtgtggggaccgcatcatgctgcctataacagaatgaccaaattggttttgtgacggtcagttttgttttgctttttaattagcaagtttatttttatgttttatagattttgtcgtaaatacagcctaattaacacctataaactgtgacatatctagactatgcaatattgtttactgaaaaagagatgaactatcaaggcatgaaaacacatggatgaaatgtatgtgcatattagtaagtgaaaaaagccaatttgaaaagtctgcatactggatgattccaactatatggcattctgggaaatgcaaaattgtggagacagtaaaaaaatttagcatttgctcgggattaggatggaagaagggatgaactcgtggaacacacagaattttggggggcaatgaaactatgctgtgtgataccgtaatcatgaagatgaatcattatatactcatcataactcacggaatatacaacatcaagagtaaaccctagtgtaaattatggactctgggtgacaatggcgtgttgatatacgtttattgattgtaacatgagtaccactctggtaggggatattgatagtggagaggctgtgtgtgtgtggaggcagaggtatgtgagtactctctgtaacttccactctattttgctgtgaacctaaaagtgctctaaatgtgtctatttttaaaacataaaataaaaataaaaaacctgaattttatattcgtaatcttcatacttttagtctcaccaccttaagtattttactgtttgccacttaccaaaatggtggtgcaattgaagaatggtacgtgattcctctatgttgtatcatagtaaagtcatgcttgcatttttttctttcttattgtagtagaaaagccatggatttcagaatctgtaagatcttagttccaattctagttatactagctgtgtataaacttatttcggtataaataaaaaatcgcttgtactactgtcagtaattgattttaaatgccatccaaacctgaaggatagaaaatatccttttaaggttataaatctatccaaacctgaaggatagataatatccttttaaggttatagtgaacattaagtaagaaatattttgaagtagtttaaaatactaataaatattaagtatacttttaatactcatatatattttccttttcaatcaatacttgtttttcgatgttcacaaagcttttgttaaaagggcaatgttttaaaaatatttctgtagagctgtagtttatcattgtgtgaatcatattacaacactagagtctcctagctcatagctaggagctagttagttcgtaactgtgtgaagaagataaatcttttgaaacgacaaagtcacgactcactcatcttaaaaggtatctcattatcctagaacaaacttggcatcattgtattactgacttccaagagaaaccaatcccattttgcctgtattgtctttcctcttaccggcattttttaataaatgctgttgacacagtagcttgctttctcacagttcagttttcctaactgtttgattccatggcaaatccataatcctattttaaatattctccaggccatgaaaatgaatgctatttatatcaattcggctgttcaactgcagtgcagaaaaagcttttgtatccagagatacaagcctctggttcaagcataaattactgggatacactgctcttttttcttttaagctgaactctccttgacacgaatccccataggtgtcttaggtaataactgatattccaagaaaaaaaattgtgaaaaacagttaaaggaaaagacaatttacatttttaatctgatagatcatgtttccaaaatgaaatctctcttaactctggtaatcaattaattcatacatatttccatcaatagatctttgaatagtggcttaattggtcttttggaaatgaatcatttgcaaaggtagagtcgtgcttcatgtactagctccctgaaaggtagtgtgcagaaagattaaatcgcaaagtggattgtaatcaggcagatcttggttcagattgtgactgtttcctacttaaactttcagttttaaaattgaacttggcagagcttattttatgaagtatgaataatatttacttcttgagtaaataaatcttgaggttgatttaaatgttaagtaatataatatatgtaaagcactatgcagaatctggtatgtagtgaaagctaaatttgagttattattatatgcaggactatcttaagtttgacacactagctgtatttttctaaactgtataaatcacttcgactaagtcaactagtatatttctatgacgtactcataaaaccaaaaagattaatcatttcttggaaagcttatgaacttataatatgcagtcctaattgaaccatgacctacaacagagttttccataccaatgtaatgtttcttggccttgttgcaccgaatggaacataagctccgtggggacagagattacatttattttggtctttgtattttgcaagttacctcatttatgaacttgcacataattagtattcaatagttacataattagtattcaatagtcatttataaactgacaacatataaaagtaaatacaggttatcaactgacactcttatttatcttattttaaaaaactttattatgataatctttttaaaaatagttattgtggtgcctgtatcaaagatattaacagaaatttgttaaataaatgaatgtagttaattttcatttacagagcatgaatgccagaatttggataacttctgtactttccttgtgttcaaattctggcaggactaaaatatgtctgtttttcctttcttccaataatatctcatgccatgtttatataattaatacagtagattattatccataaattacatatatgcaaattcaactacatgctaaagttaacttgtgccccacaaatctactcctgggtctttcacagtcattcatagacatatgcagaataacagaacaattgagttgcttgttgtctactttcccagctaaggttgaacgaggtgacactgtgccttcctgtttcagctcttttactgtaaacaattatcgttttgagggtctacttagtgacatgtttttcacatttttgtgctttctgttggtcatgttcctgtttaaaatcacttcccaccagtcacttctgcccccaagcatagtgatgaagagttgtcctgtcttccttagtgcaagaatgctgtgatgtgccttatggagcaaacacatgtgttagataagcctcattcaagcgtgagttatagtgttgttggctatgagttcaatgttaatgaatcatttaaaataaggtgtctttaaacagaaacaaatatgaagtaggttataggttaaagggttcatgaaaatgttgtgaccagaggctcacaggaacctgatcctgtatttctcctaggagcaatgattcagtagttgctaattcagtgtttatgctgagaatacaggtaaaaacaactgcaaacaatgaaaattgtctataccacttgtagtagtcaactcttagtaatcaaactcttcttagggttcacagtataatatagagatgatgggtaccagattggattacatgatcttttgatgttttctgagtctcctaatacttttcttgatgggattgaatgattggatatcttaaggccagcttccagaaataagctgatcaagttttgatatggtatattggaattctgtccactcccactgccttttccataactattcacactctaataagtagtggaacatcatttgcagagatgggatgaataggtaatttttggctatgaaatttgcttgtccccataggtctctcagatgctcagtttggctttcactgtgcagcagccaatcattacaggaaaaactgttactcttcctaatcttaagtaactttgattttaccctctcgtcatgaaataagacctacttagccgtatggaaggggagtttaagataaaggaaattgaggaatgttaaaaaagagtagaaatgttatccaaggaaggagagagaaagagatgcagattagcacagggtgaatttagaccagaatgccttaatacagatgttcagtaaagctaaatctaattctcattgaaaatcccccctccctttaaaatatctccaacactatgtcaagaaagagagaaagagagatagaaatttcttcttccaaccttgttcaagattttgccctcccccatattctttattctgttgtgggcaaggaatgtgatttttcttattgaaagttaaaaaacaggaagtatttgagatctgctgggaacacacacacatgcataaaaagatagtgaatttggaggaaagtgttctaaactcagagtaaagggctaggttctaattatctgcagatggcaaattgctggctttgtaggatggatggatggatagatagatagatagatagatagatagatagatagatagatatggatgaggcccaagcctatatgttactgcattctgctgtgggtttgcagacaagtctagtttaacttctttattgcagtcttcacctcaacacacttactgcaagagacaatattgttatcaggctaagaactacagaacagaaggtggatttatatattcccttctccaatcacaccatttgaagacatataagtcctctggatttacaattagagaacgaccagcaacctctataaaaaatagtgcagaaagagaccaagattcaataattatacacagttgttaggtctcagtgtctgctttgcctaaaatgataatgcccagcaactttttctctttagatgtgtgcctaaaagccaggtacagtgtggtaggtgactcaaagataggatgaataccctctttccccccacgatatcatgacatatttgtcttctttgaagaccaagaactcacttggcagtttgctttggcagcagagctttctgagagagagagaaaaagagagagagagagagagagaaaatattgacagaagtggtcacatttctcatctttttgtcagctctggtagtaaattcaagatttaaatttgtagtaagtatggaactttatagaacacaaagtaaatgtcaaagtagacaccaggaaaaattatttttgcttctacagccctatcacaaaggcaatctcagatttaatagttattccaaaaggagcgggagcataaagcttcattgtaaaacacaatactctaacaaatggtggaaggcttgcaatttcattgcaaagagagaacatagcacttctttgccaaatatgtggcaaatcatatttaattgaagctattattccagtgagaagaaataacaatttgacttctagggagttttaattgacagtattataatatttgtgcaatgtacatccactacaagaataaaagaagcttttacaattgcatactgaaaaatgaaagtatcaataaaatttctgtaaatcctggaaataataatatcacaatatagctagctaaagaacaattttcttcactagattcacatagcttagagaaaaataattttcacagaaatatactcatcatctctttccctaacccatcttttgtaattttcctaatttcctctgtattccactatttcatcatctcattattaagaagcaaaacatagaggcatttttgcattatgcactacagtcttttgtttgaaatttaatgggtcatgagttctgcagtccttgggaagatagtctttaaaaaaatggggatttttagatattacatacttgtagccatctgcttaatatgtcattttcaaccattactatgaaggtgtggagagtgttatctcacttcaacttcaccaacaaacacttcaacatgcattagtttttttcctatcagaaccatcactcaagaaataccagttgaatgcatataaacatggcactgtgctaggtaatgtggaggatgcaaaggtaatagacacctgtatctgacaacattctagtaggaaaaggagacttacacaaaatgtttatatagtttcactacagagtgagatgtgtcctaagagtcatgcaggaaactgtgcgagatggatttcagtagaagaaatcaatatgagctccatacgggggctttattataaggggtagaattctcacctcagttaaggtagaatgtccttgggggaaaagcaaaaaaagttcaggacacacagggagaatccatctaatttgaagtatagacgatgtaaagagagggagtgggtgataagtttagaaaaacatgtaaaagccaaaataacaaaattatttaacatcagatgaggcagtttgaactttattttacaggcaatagggcattagtgaaaattttgaacaagaaagtaacataatcacaattatactcaggatagagtggattaaataagcaatggaattgatattagaaagaaaaattaggcataaggcacagagagggtgataaacttctgagctagaatgttttatattttcatttctgcctaacaccaattcttggattacctggatgttactaagaatatatatacatatattcacattaagataaagctatgatcaataatgtttcttttttaatttcagatttttcattattcgtatactgcttcatatgtgatttacaacatacacactaggtaagttctttgattttctagttttcatgagcaattgtgttactaaattgttggtgtagatatcagtttgttcatgtaaaaatattcacattttttcaagggaagtttgggagttaaatcctccagaagtagaggactccgtcttgcagtacgcggcctggggtgtccaagggcagcagctggtaagcgcaggcattggtatgcactgaacactgccaatcatggttttatggaagatgttaactgaaactttggaaaaaccataggaaaacttgtcctacaaaactttatgtttccctaagtcctttatatcttttatctaatagtccaacttaagaatacattaaatgatactagtattattttatcagttaataaagacaaaagtttattaagtaatatatgattaaactgctggtttataatgaaacctagaagagattcaaggttactaggaccttgtactgcatactttccattacataatattgtcagttttcatgaaaaattcaaaataaagattattttttcttaaagcattgttcagggtaaaaatttagacagaattatttaatattctcttaagagaggatttttacttttatttttattttgaaattattacaaactcaaaaagataattattgatatataaagcagtttgagcaattatatatatatgtatgtgcatgtttattttaggcaaagtcttgctctgtcatccaggctggagtgagatctcagctcgctgcaacctctgcctcccaggtttaagcaattcttgtgcttcagcctcctgagtacttgggattacaggcacatgctaccaggtctggctagcttttatatttttagtagagacggggttttaccatgttggccaggctgatctcaaactcctgacctcaagcgatccacccacctaggcctacccaaagtgatgggattacagacatgagccagtgagccccgcctgcaatattatattcttgtacatatctcatggtgacaatgtaaagcctttctcaagggaatattgctcagggagtagtattgcttactatcctgtgcatgctcagatgtactgagcatcaccaaactgatttctaggttatttgttaagcgtgtttacacctaccagcaataatgagagcgttcccttggttccatatccttgccaacacctgtttttccagacttttaaataattactcaaatgatgatacaaaatagtatttcgttatagttttattaacatttagtatttccttgaattctaataagctagagcaacttttcatatggttactggcaatttgtattttttcatatgtgaaatatctattcatatatttgtccattcacattttttattcttttttttttagttaaaaggaaccccttatatgttctggatattaatacattgtttggtctatcttcatccagttttcggatttacttctcactctcttaatggatccatttctacaaacatatttttttataaatgtagtctgatttatcaaatacatgatttgtactttttgttattgatgaaatctttacaatgaaatcatacttctctagaatttttcaagtgggccttccatgtataggttcttgatccatccatctgaaattgctttttttggtatggtattaagtccctatccatttttatatatgttttatatggccaacaattgtcctgaaaccttttgttgaccacttcattctttaactattcatctgcagtgttacagtgttatgctgtacatatccatgagtcttcttccggctctttttttcttccaggtggtttgtctattagtgtgctaagacaacagtatcttaattaaaataagctttactagctgacaaggcagtttcatatgctgactttgactcttcttgactttttagcctttcatatgaatgtcacaattgtctttcatgttacatgcccattttcagaattttgaatttattatttgaatctatatgtctattttgggaaattaacatcttagtgatactgaatcttcatatctacaaacatttaatgtatgtatttagttatttaagactcttaatatctcaaattttacaattttatatctaaaaatttacactttatcattttggtgactcttttaagtgcttgcatttcttattttaaaaatgtttgctactggtaaatagaaaggtactcaaattatttatttaatatatatcaaccttgctacgcacaattatatattccaaataattctgtgtagactattatgctttttgttaataatgacatttttcttttccatttcaatttttataatttctatgtcgttaaaatccttctgcactagttaacctatgaatgtaactaggtatggtggggttttttgttttttgtttttgctggaatactaaaaaattgattctattatggttactgggttaagttttacaattttttttttagttagttttagttagtgactgcaattgatgagacatgctttatggcttgggattttttcaaaatgctttttatgtgatggataattttatatatgttctatatgacaggaacaatgttctatatgtgcctacaggatcaatcttaataattatgtttctaagagttatattttcttactaatgacagtggatatgtgatttttttctttagttgtcagttttgcattatataatttgaactatgttgtaaagaatgaggaagttataaaatgataaatacatctttctattgaattcaaatgttttataccttaataaatatatttaccttatttacctttaataactctgattggccaaccctcatcctatcctttaactagttcttttaacgtagtttagaatcctctaggcttttttaaaatttgaattgctgttttaacaacagctggttgggctgagttaagtttttaatttcctgcaagcctcaattttctcatctataaatagaaatatgtacaccatcatatcattgtgataattattttggaaaatgactatttttcataataagatgcacattactatgatttatatcctattttataaatctgtatatttcttaagcttattagtgaaatagggtaattataatagatatttcatatcatgagaagcctacagaataatacactgtggctaaataaggtttcctttcattggaaaataatctggaccctcaaatattcaaagaaatcctacaaacaaccctgcattcactgtcctttccacactaaatggttgaataattgagtaaatcattatgatgaaaaaaggttagtgatttaaaatgaaaaatgtctgcaattgtccagataccacagattatagacattatatttgcttttatcttgtagatatttagataaattaacaaacaatgcatttaatctaccatcacagaactctctgtaatctatcccactatgatatttctgaaaagtggcagcaaaatttgcatagaatatggtaaatatgaatgtgcagggtttggtctagataaggcatgtaatcaatgaaacattcatggacaatggtgagtggacaccaagaagtggcaggtgctctcatccttcctgtttcactctgatgttgtgaacaatagagctggtccattgggccagaagcaactttggaacaaaccaaattccagaacacagaaacccaagacaactccaccttttgtacaaaatactgcccagtattttagaaaaaaatggacagtattttggaaaatcttttacactttggttggttttaaatgaccctcttattcttcatacttgagggaaaccaacacctatgacaaaataatagcactttgatacactcagggaaatagtattaatgtatgcattttctttatttgttattgattccttattttttaatatatttaagaaaattatgaaaatactaaaaatgtataaaaattataggttccctgtttgaagccatattgcaggtgattacattctggttctactgcttactagctgttgatcttgagaacattatttaatcttgatatggcttactgtttccatctttaaaatggtagtgctttatcaatagtgctattctggtgtttaatgtatgaaatacagttctaaagcactttgaatagtatctggcctataataagtattttgtaggtattcacttttactattattaaaaaatctgttttcatatgaatttaaacaccttagggaactttagggtgactagttttgtggagaattaagcttaagttttctgtaatgtcatttttcaaactcctttggggaattcttaagagaaatttcatatttatctagtttatcttttgagtgcatgcaaacataaatttaaaaaagtaaaagacatacttctacaaatggccaatggtccatttcatatgagtttggcatgctttgtcaatatttgaagctattagcaaactcagcaatatgattttattagagatgagtcattacaatactttaattagttttgcattaaataaagaggcttgtagtgtttactaactaaggataattaattatccttcattttcagcttctaatcttatttgctgtaaaagaaattcctggtattatagaagagaggcaagggattgacataatttactgaggaagaggatctaagttagaactcagaatattgaggagaactttcaatagcactaagtgtgagtaaaggcaatttagatgtgtcaaaatttgtggaaaaatgaacctgaagcaataaagagtgcattatttggagaaggtggtgagtgaaccactttagctgtaataaagttttattgaatagaaatggtttgggaagaggaatctgggaattatggtagaaagagaagcaccaggaatctgtttttccattcagataacaattgctacagtagacatgtaactattgagaactctagtctattgaaagtgtgtaaattttatgggaaggcttgaatggaagtttgtggttaattttagttgacttgaactcttagctcagaagcagctacctatcttcgaccccagccccatggcaggcagctgtgcttatgttcctggagcatgcattcatcttgcaggaaccaggatggacaatgagggccctgtgatgcaaataagtaaggatttgtattcttattgtttattgccccttctcattatgaaattgcagatatagaggaaggcagctattgtttcacatccttacacccttataacaagctcctctccctccagctgaagtgaattctaaggtggttaaaaggccagtgccctttcctactcttcatttttctcttttttgagggatgtcagccattaaaaattaagatattcaaaggcaactgaatgtatgggagaaattagcaagtcaccatacatgcacagggaaagatgcaggcttacaaaagatctgagaagacttttttcacataaggctgattctcagcataaagacagcctccaacaattacaaaagaaccaacataacaaaacaaaagcaaaaacataaaatagaaaaccatgggaaatgggaatgtattagtccgttctcatgcagctaataaagacatgcctgagactgggtaatttataaaggaaataggtttaatggactcacagttccacatggctggggaggcctcaaaatcatggtgggaggcaaaggaagagcaaagtcacgtcttacatggcagtgggcaggagggcatgtgcaagagaactcccctttataaaaccatcagatctcatgagacttattcactatcatgagaacagcttgagaaaaacctgcccccatgattcaattacctcccaccaagtccctaccatgacatgtgggaattattaaaattcaaggtgcaatttcagtggggacacagagccagattatatcaggggagattctgatttccagagataccaaaattattagattcaaattgtctggttttcaacaataaaaaaattacaaagaatacaaagcaataaggaagtatggcccactcaaagggataaaagacccaacatcaagaaataatggaagtcatggaaaatatgaagaacatgatgtatgaacaaaatggaaataccagtggagagagagagagtaaacctaaaagacaccaaataaaaagttctagagcaaaagcttacagtaactgaaataacagttttactagagagtcaagatatacttgagcagggagaagaaagaagtagtgaaactgaagataagacaagtgaaatgattgagtattaggaacataaaaaataaaagactgaagaaaaataaacagaacctaagggacctatggaataccatcaagtggggcaacataaggattatgggaatgttagaagtagaagagggagatgaaggggtagaaaaaatatttttaaaaattaacagccccaaatttgatgaaaatcattagtataaataaccaagagctcaaaaaatccaaataggatgaactcagagacccacaccaagacaagttacaatcaaactgttgaaagacaaagacaaagagaattttgaaagcaacctgagagaggccctcctcgcttgtcacatacaacatatccttatcagcagatttctcatcagaaacataagaagccacaagacagtgggctgatgtgttcaaaattctaaaagaaaaacaaaacaaatcaaaatctgttaaccaaaaatttcatgtctggaaaaactgtgtttcaaaagcaagggagaaattaagacattctcagataaagaaaaattgacaagagttaccactagacctgccctgcaagaattactagtgggagtccagcaggttgaaatgaaagtacactaggcagtgatttgaagccttataaagaaataaagatcccggtaaatgtaaatacatgggcaattatagaaatgtatgttattgttacaatgatttgtaactgcactttttcttttctacttaatttaaaaagctaagatatttaaaatttttagtctaaaagctaatattattttaactttaatttgtatttcacattttttttagacataatttaagaaagtaatgccttaaatgtcattagttaatacctttggatgtacaatatacaaatatgtaattttgtgacttcaataattgagggaggtgaggatgaaactatgaatgagcaacgtttttgaatgttattgaggttaagcttgtataaattcaaatcagcactataactttatgatgttgcatggaaccgccatggtaacaacaaagaaaataataaatatacacaaaagaaaggaaatgagaatggaattaaaacattctactattaaaaattaaactcaaataagacagtaatgtggaaaatgagggtaacaaaagataagggatatagaaaagaaatagaaaaatcacaaaagtaagttattccttatcagtaattactttaaatataaatagattaaattattcaattaaaagaaactaagaagataagttttaaaatataatatgattcaactacatacgctctataagaaactcactgtagatacaaagacacaaataagctgaaaataaaagaatggaaagagatatttcatgcaaacagtaagcaaaataaaataggggttgctatactaacgtaaaaataggcgttaaatcataaacagttttgagagacaaataaatcaatacagtaagaagatataacatttcaaacatttatatacctaataacagaccatcaaaatatataaagctaaaaatgaatataattgaagggaatatatatatatatatatttctaccataattgttggtgatttcaacaccatactctcaataatggctagaaaaaccagagagaagataattaagaaaatagaggatttaaaaaacacagtaaggccaggtgcagtggctgacgcctgtaatcccagcactttaggaggctgaggcgggcggatcacgaggtcgggagatcgagaccatcctggctaacacggtgaaaccccgcctccactaaaaatacaaaaaattagccgggcgtggtggcgggcgcctgtagtcccagttactctgaaggctgaggcagaatggcatgaacccgggaggcagagcttgcagtgagccgagatgtgccactgcactccagcttgggcgagagagcgagactccatcttaaaacaaataaataaacaaataaaaaacacaataagccaactagacttagcagatgtatacagaacactcaacctaacaacagcgtacacgttctttcacgggcgtttgagaaattcttcaggatggatcatacattttgccacctattaagtctcaatagcttttaaaaaattatcacacaaaagatcttctctgatcacaatgggataaagttagaaatcaataacaaactgaaaactgaaaaatttctacatttgtggaaattagaaaacattctctcaaccagtgagttaaaaaattacagaaaaattagaaaatacttagagatgaagtaaaatgaaagcacaacataccaaaatgtatgagatgcagcaaaaacagtgtaagcgggaagtagctatatatacttactgctgtggaattaatggtgttcccacaaaatttatgttgaagccctaacctccaatgagactttgttagtttgttggagataaaagttttaggaggtaattaagtttgtacaagatcatgtgtgacgctttaatccaacaggactggtggcttaaaaaacagaggaagatctctcactctttctcttgctcttgctgtcactctctttcactcttgctctttgtctctctgtgcatactcaaaggaaaagtcatgtgagggcaaagctgccatctgtaagccagtaggagagctcttaccaaaaactgaaacatgttggaaccctgatcttggattctttagcctccagcactgtaaataaatatatttctgttataaactgcactgtctttggtattttgttatggaaggctgaaaggattaagacactcacattagaaaacaaaaaaagatctcaaatcaacaacctaattttacaactgaaggtactcaaaaaagaaaaacaaactaaacctaaagatagtagatataaacaaagtagataattaaaaacagagaaaatcactaaaatcaaaagttggttcttcaaaaaaatcaactaaattggcaaacctttagttagcttgactgaaaaaaaaaaaaacaaaaaaaaaaaaacaagagaagactcaaattcctaaaatcagattgaaagtggggatattatgaccgtttctacacaaataaaaaggattataatagtactatgaacaattgtataccaataaactggataacctagacgaaatgaagatagtaccaaaaatgcaaaacttcgtagtagagtcatgaagaaatagaaaatctgaataggcttatagttaatatggatattaatgcagtaatcaaaaacctcctggccaaaaacattctggaactgatggcttcatgggtgaattctactaaacatttttaagaaaacctaacaccaaggccaaggcgggcggatcacctgaggtcaggagtttgagaccagcctggccaacatggtgaaaccctgtctctactaaaaatacaaagattagctggatgtgttggcaggcacctgtaatcctagctactcaggaggctgaggcaagagaattgcttgaacctgggaggcagaggttgcagtgagttgtgatttgagatcatgccactgcactcctgcctgggcaacagagtgagactttgtctcaaaaagaaaaacaaacaaaccaatatttctcaaacttttccaaaaagtcaaagaggagaaagcacttcttaacccattatctgccagcattatcctgatacaaaaatctatacatgctacaaaaaacttacagatcaatttttcttatgaacatttatgtaaaaattctcaacaaaatactaatacaacaaattcaactgtgtaaaagattatacaacatagctaactgggattcattcttgaaatgtaaggatcattcaatatataaaaaactgatcaatgtaattgtattagtcccttctcacatcgctataaagaaatatctgaggatgggtaatttataaagaaaagaggtttaattggctcacagttctgtaggttgtacagaaaacatggctgggaaggcctcaggaaacttttactcatggcagatgggaaagctggagcaggcatcttcatgtggctagagcagaggaagggggtgagagttaccacacacttttaaacaaacagatcttgtgagaactcactcattatcctgagaaaagcacaaaagtgatggtactaaaccattcatgagaaacccactgccatgatttaatcatctcccagcaggcccctcctccaactttggggaacacatttaacatgagatttgagtgaggacacagattcaaatcatgtcagtagtatactacattaatgaaattaaagaaaaaaaacacataatcatctcaactcatacagaataagcatttttaaaaatttaacacccttatatgactaaaaaaaaacaacaaactagaaataggagaaaagtacctcaacataataaatgtcatcatgtatgcaaaatgaacggtgatcattatacttaatggtcaaagactgaaaatagtttctttgagataagaaacaaggcaaggatccttccttttgaaacttgtattcaccacagtactggaagtcctagcaaaagcaattaagcaaacaaaaaaataaaatcaattcaaatggaaagaaaaataaaattatttccatttacagattatataattttatttctttaaaagcctagagtccacacacacactcagcattttagaactaataaacacattcagcaaagtactaggataaaaagtcaacacagagaaatcatatacatttgtaagtctatacaataactgtgggcaatctgaaaggaaattaagaaaataattttatttacaatagcatgaagaaggatagaatgctaagaaattaactcagtcaaatagatgaaagactcatacaatgaaaactaaaaaatatgtctgaaaaaaattaaaggacacataataaatgtaaaggcataccatgttcatgaattggaagatgtaatcttgttatgatgtcaatatgcccaacacaatctacagattcaattcaatccctatcaaaatccaaataatgtcttttttgcagatatagaaaagcctatcctagaattcgtatgaaatttcatagggcttcaagtatccgaaacatttgtaaaaaagaagaaagttggagaactcacactactgattcaaaacttactacaatgtatagaattcaaaatagtgtgacataaattaactgtgctggtacaaagacagtaatatagaccaatggaaaagaagagagagtccaaaaataaactttcgcatttatgatcaaatgaaggtgccaaatcattgaatcaggaaaggactatcttttttaaacaactgatactggaaaaactggatatccacatacacaaaaaataaactcttacctaatatcacattcaaaacttaactcagattggatcaaatatctcagcataagctctaaaactataaaacttttagaagaaaatataagtcagaagtttgaagatattggaaggaataaatgaattgaatcattttgcagtgctttcttggatatgacacaaaagacacatgaaattaaaaattgacaaattagattttatcaaaacttaaaacttttgtgcatcaagaacactatcattggagtaaaaaggcaacatgtggaatagaaaatatttccaaatcacttatctaagaagaggttaatatagaggaataaagtatacaggagttcttatatagagggattctaaaacgtaataaaaagaaagcaacctgattaattccaaaatgggcaatgaacctagatatcaaaaaatatgtaaatggccaataagttcatcaaaatagcaattcctatggaaagaagtttgatcttaatatgaagtggaaccttaggaattaaccattttcggtaggtaaacacaactgaatatagatgccttgatataattccatcgcagtaagtagcaaagtgtaagttaaagtgagctaacatttcatgcctatataatcatcaaaagtttaagtttgataataccatttactagtgagaataccatttactagtacacaatagggacatgtatatcctgccaaaggactactagtgacacaatgaccttgaggaacaaggttaatttccttgttcctcaaggttaagttccttgttcttcaaggtcaagtttgtagaacttagtcgtgttgaagaagtccatctctaaccctcagagagtgctggtgggcatttaaaatggtacagcctctttggaaaacagtctggtatctcctcaaacaattaaacagaaagttatcatatgatccagcaattccattcctaggtatatgcctaaaagttcccacaaactttgtacgcaaatgtccacagtagaattattcatagtaaccaaaaggtgaggaaaaacacaaatgtctgccaacaaatgaatggataaacaaaatgtggtatattcaaacaatgaaattattattcatacaatgaaattattcagccacaagaagaaatgaagcactgatacgtgctacagcttggatgaaccttaaaaacatgctaagtgaaaggagccagtcttctttcagaagtcaaatatgatttcatttatgtgaaagtccagaatgaggaagtttgcaggacagaaaggagattagtggttacttacagttggaaggattgagggatcagggagtgatagctaaagtatatgggacttctttttgagataatgcaaattttataaaattgactgtgataatagctgcacacatctgtgcatacaatacaaactataaatctgtaatttttaatgggtgacttgtttggtatgtgaagaataggtgtttttctaaagaaagaactggtaagtcctacaacagtaagttaggcattcagttgaaaaggcttgtggtgcaagaaggtgtgtcatttttctttttaaacaaatgtagccttataaaggtcagaattactcattgtagaacgttttgaaattgatataattaataaaaacagaaagtatacttatctataattgtatcacgaagaatggaataatttcaaaaatcaggtgaagggatttcacctttagaaggaaaaacatagtactaattagaatgaatctagaatcaagaagctcaagtccagattattttccattcttttccttactcattttttaaatttatttattattattattattttgctttgtgatttagggagagttgaaggctgtacgcttaaatttacttacattacaaatgaaagatggtcataactagttccagttttgtttaagttttaactgaggtatgtcaagtgtatcagttaaaattctccagaaaaacaaaaccaataggatatatatctccatatatatagggagagggagaaggattttaacgaattaactcatgcaactgtgagggctgacaagtttgaagtctatggagcagaccagcaggctggacaagtattaatgaattgatgtttcagtcttgagtcctaaatctgtcgggcaggttggcagttgggaaagttaggcacaatttcttgaagcagaattcatttttggggggaaacttcatattgtacccttaaggccttcagctgattggctaaggaccatccatattattgagaatattcttctacttaaaatgaattgattgtaaatgttgatcacatcgactaaatacctccacagcaacgtctagactagtgttttaccaaacaaatgggcactatggcctaaccaagttaacacaagaaattaaccatcacagtaggtatgacacttcacacagtgagaactcaagaaataatagctattattttgttcccacctgttctttcctacaaataattcacttaattcagagcctcatcatctttcacctagatattttagtagcttattttctaaaatttgttctcacatctccagtcattctaattcagccaccatccgcagaaatatatgttaaaattgaatgtacttaacagactcccacaaggttataaaatgtcattgaagtgacactcaatgtcattaatgtaactaatgtgacaactggtccatcatctgagctcctgccactccagcacagagcacatatttttctctacctgaaccaaactctttgtgatttctggatgaaagacacctgactcctctgtgtctctgagtcattcctcttggtagacctagccatttaaaaaaaaaaaatttccttcaaaagtctttgttaaatactttctctcttcttctctgataatttttttctaacccttactccatgctaagtgaatagttcgctttttgggattctggcattcctctctctcaaataatttttaatactatttatttatgttgttatcttctaccactaactgagggggaacacctagaatacaggatctattaaacattttttctctctcatttgtttttctcctcctccatttcttcctcctccttttttgtaaaatttactgtagctcaaggcaaaatgtaagtttaataaatttctggttgctttgagaaactgatgaaagacttattgttatttctgtgtaaaacaagaaaccaaaggttttgaggattgtataatatgggaaaaagtcatgtatgagaagatagatcttgtaaaggaggccatgatataccataagctattgaatctggaagcagggagctaggtgtagaggccatcattataatctggaactgcaatgataatcaaccatatatcaatataacaagcttttatgctgagatctaaaatttgattgctattcaaagataaaaattatcttataaacctaattaatgtaaatgaaatgaggcaaatattaaagaagtgtatttctaaaggtttctttttctttttacaaaaatgtcctctttgagactccttccctgaaattgctaatatttgtttaattttttatattgttgaaaaatgtaatgtttaggtaattcttcaaatacaaacaaaaattatccacatctctctatcacctgtgtttttgctattactaggaatttatcttaaaattttattaaaacctcaaattatgagcaatggtttagtttctttgggagactttaaatttgtgatataatctcttacttcattactaataacaattgtgaactatttgatcaatttttcccgagtagtatttaaggtagcacttttcaaacatatctttgaaatctcacatttcctactaaaagtcaatgagattttgcttcatattccattaaatatctatgctttttaatacaaaagtaattatttttaatctcatcaggatgtgttcaagaaatgtatgataagcatacacaaatatatttgtgtgtttgtatgcacacacacacattcacacacgttactgctggtgccaagcacgttctgggctgaaagtcttggccttagagtcctattataccagagctttaatggaagtagatgaggaacaaggccagcaattgacgaattctatttcaagttagttatttaactgtagtttgtatgatgctcatttctagttggtagaatgatgcagggaaaccactagggagtgaagccaaacaatttacactattaatatcaagtgtttgacatgatgagtgtttccaatataaataaatttggaccacttttttgttgttgtttacctcattcatcttcattagtgaagataactgaaatccgattaccttttcattttatctgaaacaaaatcgaatgttcctgcttttagttgcagggtataaaaacaatctcccttaccacattgtagtattgccccatatctaacgtctaatgggtctcaaatcaaatttgagatcaggaaaatcaataccaagcagctcatatcatttatttactaaatatttgggccagaaatagtaataaactgtaaggggataagtctgtttgggtttaatgggggggaaaaaaacaggaaacaaaacctcacctttaaattatcttaactatcttcacttataaatttgcaatgtatttaggtatatatttacatgaatatattacatatgtaaatgtaacaggaaatacaatgtcacataaataaaatgccttaacattgtgcaggtatgtgggacaaatatgcaattatgttatataatttaaaggaaaattaatttgcattgctgtgtaaaaatcacctacacatcaggtgagcaatcccacaaacttcctttaattcatatttaggcaatattttagtcatttagaaataataaggtatttgtaatgactttatcttttttctcttgttttccaatgtaaatcacaatttctgtggcacgtcttgtttcatcctgctcataacataatattaaatattaaattgtggagtaagaaccatcaaaatcatgggattgtagattttctaactgttcacctgggtcatgcataatctaatatacacaatgtatactttagacagttcctgctaaggaaactatttgaatgaaagagcaatgtagatgacagttagtgaaagttcctgaatattagactctttctgtatcattgcaactaagcgcttacaccatacctattattcttacatttgatcagacagggttaacctagagtgatatgtcaagtttcatttgatcagcagtctaaacaaaaacttaagaaaaatgataagattataatagtatctaccacaagatgtgaaccatcttacataacccctgaggttaaaagatcccaattaggcagagttcagtactttagtgatttactgtgttttattaaatggcatgcagataactccccaaagggaactgtggtctgcattaatgtcgagactcttcatgtcagaaataacttcagacatctttcaagtggtgtggtagaggagctctccgcttgctctcctccttaagaacaaccaaagaaatgaaaataaaaaaagacagtacaatttttatgttacattaatcagctacagcctaatctataatctcaacggaacatagagtaaaaagaaatccacagccagaaaaggattgaaagcaaatatacactttaatagattttgagaaacacaaagaaatagacaaactgacaattttagctggtaatttcaacatttctcttacagtaaaacatgaaaaaagtagataggaaatcagtagggtataaaaggtttgattaacactatcaaccaaattgacataatcgacttttatagaacactatatgtgataattacagaatacttgacatgtttaagtgcacacactgggccataaaacaagtatcaataaatataaaagaattgaattcataccaaattatattctatgaccataaaggaattaagtaagaaacaaacaaattttacacacacacacacacacacacacacacacacacacacacactctctccacattttttattggaatacgaatatatctaataagtaatatagtattatacatctagtgattctgaatgtagattttgtcctgtaaatatattacacatgtgtctcaagacatacattgagaaaattcattgcaacactatttataattttaaaaacaaaatagaagactgaacacaacttaaattattattatgggactagtaaaataaactatggtacataaaataataaaatagtgacttcttcagaagccattaaaattaatgattcttctatatgtgcaggaaagcagtgctatccagtgataaaagaaaggtccatattgttacttagcatgttattattacaataggtaaaacattcccccaaaacaaaaatatctatatattatttaaatatttccagaattatgaataacaagatgaaacttaaattacagaattgattacttttaacatagcatatgaaaattaaagcacatcaggaacttccaaagtaaagaaaaaggtggcaaattgttatatatatggatatagatatagatgcagatatcttattttctgaagtgtatgtcagcagcaatgatcacatacaatggcatgagattctacgtgtgttacacgtgtcaaacataatcagagacaaaatagggaaagcaatatgttaaagtaaaaataattattgttttagagtagtagaataatgttggtatggtctttaacgtttatgttattatgttacatattgttttaagtgttagaagaggaactagaatatgaggagcaagggacataaaggactagacatttaaagctgaatttaaaaagcaactgtgacttggaccttaattctacttggtaaaaaagacttgctaataatattgaagttggctattaaaagaccgtggtaagtatcttatttgtttctgatgtgctctggaatggaagtagaatgcaaagatcattatattacaaattggtactcaactcttaattctttcaaaattatcctaatcactgtttctaacatcccagaactaaactgggatatgggggtgaataatgtcaagttggctgttcatttaagaaaaacaaagcttgtccactaacttttttgatttcccttatgttattcaaattcagtatcttccaaaagagctttttttggggaaaattttcaccatcttctaaccaattttatatctctaacataaaaacctgtccctgaaagcataatgacatttgtaaacatactaataattcagatctttacacttattcttggaattagaatcaaaactagatataaaccacttcaccctttaaaattatataatttacttgacattaataaattcttcttgaaaaggaaaaataaaaatactacacctggatatgatgaagaatgtactggaaaataacctttcacttcagagcaatcacaatgaaaagaactttgactaaaattgaataaatggttttacaaccctgatatagaagagcaattgctcacacatcaatcttcacgcaaattcagcaataaactctgacaaaaccttaaaacaaaccaacacataaaaagctacccaaggactcaagcctgaacaaaaccaggcagattttcgaagggagtgaaatttacaggaaaatagctcacaaaataggattcctccattttgttagttttgtttagagttttagcctaagggcaactgtagtggaggcagagtgtgggtatcaagtaagttgaatctctgataggaaatccgactgtcgtttaggcaagaccaagagaaagagcccttgagtagctgtaactgccagagaatgagaagaatccctgagagagtcagagcaggggtaactagtggtgtgcacgtactcaggcaagtgtttgactgaacttcaactataaatgacagaattttccgacgaagtctttaaagctgctattctaactgtatttcctgaccttcataaaaataaatgcaaaaggaataaaaagataggatatatcagcatacaaatacacctatcttaaatctattgatatatttatatatcttatatatcctacctttcatagacagatacacgaagaatattaaaaagaagaaaatggacacttgtagaatttcgaaacagtatttaaaataaaaaaaaaattggatgggataaagagcagaatgaagatgagagagaacagagtctgtggcacacagatcaataaacaacatttaatctgaaaaaattaagaaatttacaaaagagagaaaaacaaaacaaaacaaacaaacaaaaaacagacccctagggacctgtaggaaaactgcaaatctctaacagatggtgcttggaatctcagaagaaaaggagagaatggagcaggaaaaatatctgaaaaaaatgatagaaattccaaaatgcaataaaaaacacaaatttacatattcaaggtgctcagtgaactccaaacacaatatattcaaggataatccctcaaaagtaaatgttagcgaaactgttgaaaactaaagataaagagaaactgtggaagtgaacagagacacaacacaacatataagtaggaccaacattagaatgcttacagacttctcattaagaaccatggggaatcaaagtgaaataaagacagtttctgactaaagaaaaataagggacccacactacaaaatatgctcttcagtgagaaagaataatatgataggggaactcggatcttcaggaatgaaagaagaacattggaaatgttaagtatatgagtaaacataaaccactaaatttcctcttaatttctgtataaaacgtattactgttaaaagcaaaaatgacagtatgggggtatgtatgtctgtatgttgtgtgacaactataacgacaaaaatggtgagggagaaagaaaattatacatttgtaacatttctatgttttacatgagattattatcttccttaataataattttcacaaggcactttgaatttttagttactgataaaaatcagattgcctgataattttagaatttaagggtatgtggtaaatgaggtagtttattttcatcaaacaataatagcatcatggattcataaacaatgttcattttttttctaacatttggattacgaatacatttgaaaagttgaaacaagtcactataaaatgccttcaaaatgattgacttaaaatttttcaacttttttctagaacattatgagcttttaaaatttgaggttattttattcttattcccaaaacctaagatgtattcgcttggtagctaatctagttttaatcatgcagttaataaaatatttattaagtaatcctgttttgttggtagcctgtgttttgttggtagcctgtgttactcccaaaggtcataaccttcaataatatagttaataaaatgtggaaaatatttccacaaagaaacaacaggacttgagtttttaaagaataagaagtttgcttttagaatctgtaatgtgttagtcactctggagaattcagttggaaaaaaatgaaagaactgaactgctgagatatttaaaatctagaagcatgaggtgataagtcaagaaatactttgggcaaaactgaaattcgtatagcacaatagcatgcagataaagctaggtgagtacatgttttttctttttctgtggggtgaggggagtgaatagtggattcgctgtcttagaaccacagtttcttaatttcaggtttgaaagttatatacattaatttgcagaaaagaaatagagaccttacaaaagaaaaaagttacttgcaaagactattagggacaatttggtaagtactgttagagaaattaaagatgagaaaaatgagggatacacataaagaatgggattgtcttggttgacctggaatgctacagtggctacgtatttgcagagattataaattgagagtcattctggattcttgtacatcataaaatggagtttaagattactctagctgttgtgttcaggatggatttattcaagaggagggtgattgtctgagatggagtccattgaaatgacctttcaatggagatttgaagtgctaatcctatataggtgtgggaatgaaaaagatgcacagttggtaaataatatgaataagagtgatttttgtggattttgattgaaacaaggcaatgtgaggaggccgagaagataaaggtatcagaaataacttcttaaagatgagtttgttcttactgctagactttgctgacattgagttgacacatatcccaaagtgttatgcaatttgaaagctgtaaaaataattggttcttaaggttacatatagtgatccatatattagttcatttttacttaagaagatatactttaaaatgcatttttaagagttttcctagaatattggacctataaaatggtctggttttttttttttttttttttttggaatcattgtctaatgcatttagcacagcagttctcaacctttttggcaccaggcactggttttgtagaagacaattttttccatggactggggcaggggagggatggttttgggagatttaagagcattacatttattgtgcacttgattactatgattataacattgtaatatgtaatgaaacaattatacaactcaccataatgcagaatcagtaggagccctgagcttgttttcctgcaactagatagtcccatctggggtaatgggagacactgacacaattagatttcataaggagcatgccacctagatagctcacatgcatggttcacaataaggttcacactcctatgagaacctcatgccaccactgatctgacaggaggcggagctcaagcaggaatgtgagcgatgggagtggctgtaagcacagatgaagcccatggttcacctcctgctgtgaagcccagttcttaacaggccacagactggtccatggcctgggggttagggacccctaatttagaaaatacaatatagtatcctagttctcaacattcgcaatgaaattagaaatagctttgaagagtcctgaattaaatatatatatatatatatatataaagaaactgtcttaattttatttaacacaatgtttcatagttgttttaccccacactagggatcagcaacttttttctgtaaagaatcatatagtaaatatatttggctttgtaagacaagagacaaaaccaaagttatgtaggtgcttctacaataagatagaaatcaaaccgctacaaaattttattgtagttattcaaaataaaataataagtacaatgttatgtaatacaagcctacaaatgaaaaaaatgaaatatgtttttgcaggttgcatgtaagtattccctgtcatcaagtccattgcaaatgttggtctacaaaaaccatttttactttgcatgctatacaaaaagaggaacagactagattctgcctatgtatcctagtgtgttgaacaccactctagaccatgaaaacaaatttttttgacatgatgcctattagaatttttttttagaaaatcactcttctacaatgaggagccaaaaagtagtaaatctgattggaatgaacctcatatgagaatgatttttttatgaagaagtagaaacgttttgatgtaaaaaaaattaaaaaaataattaaaagaaataggtagcaatgagcatcttgaggtgtgagttgataagcagcagtcatgagagagggcagctggaaattgagtcataaaggaagacctagacgtcagttatggcaaagaaggagaaggaacactcagaagagattgaattgagagtagaggtaagttggttggttatggagtgacagtttgagaatgtagagttaaaggttttggaatgctgaatggataaaaagccagggattattgaacattattatgggaatgataaattgatggaaggtcaatttttagtggcaacaggcttacaatctggggatgactggtgtgaacaggaatacatgacatgaaagatttatgtgatattgtctgtgtgaggaagggggtcactaagcctagtgtcagggagacttagttgctgtgatgatgggattcattgaagctccttgttctagaataaatgctattacaaagcatcatatttcttgaagcatgtgatgaaggattctggacaggagacttgcactgcaacctgagagactgtgcagataacttagaatctgggtgtacttcctcaattctcattatcctcctttttgtcttcctcctcctttttcccctctttggattacttttacattctcaggaatttcaagtctcttcagagagacttttatgaaagttagttcatgtcaaaccatcatctcttttaatctcttcttatcccatcatccatttataaagccagaatgtttatgcactggtgacacctgccccagaagtccactgctcattttctcctcagtcacattaaatcttttcaagagttatgatgccgagtcatcactgaagactgaatttggactttcctgtaaagtctagctgtctaaacatctgcttttctgcttctattcatttcaggttagtctattctaatgttaaagtatcacacagaaccacacccaccttccaccaaaggctgatgtgaaaaacagtccattttcactgagcacatgttgtttgtttactgtattaatacctgtaggagactcatatgggaaaggtgtttggaggttcagtttgagatatccttttaccttaattgttatattacagtaatgttgagattgttgctatcctgttcacttactgcttttccactagagcagaatgcaaagaaaataatttccagatcaattaaaaataaaacaaaagatcttaggatcatgatttttaaatgtcttgactctttatccatcattgtatctccaaaattggaccagtattgtactagccagtttttaggtggaactattcagaataatcaaagtaaacagtgaataatttttaagaaagtgtctccctcttatctctgtgcgttttccctacatctctcttgttctccaataattcttttacatttgtatcttgaccccactctttctctagcatacatgtctttgccttaacatttgcctttctttcctttgggttctttctatacacagcattttcaacatgtgtcatcttgatctgccttttctcatactagtttctctacttggaatagccctttctctgcttagaaaaatctactggatgggcgccgtggctcaagcctataatcccaacaccttgggaggccaaggcaggtggatcacgaggtcaggagttcaagacgagcctggccaagatggtgaaaccctgtctctactaaaaatatacaaaaattagccaggcatggcgacaggcgcccgtagtcccagctacttgggatgctgaggctggagaaccatttgacctgggaggcagaggtaggagtgaggcaagatcgcgccaccgcactccagcctgggagacagagcaagactctgtctcaaaaaaaaaaaaaaaaaaaaattatgaaaagccaggcgcagtggctcatgcctgtcatcccagcattttgggaggccgagggaggcggatcacctgaggtcaggagttcaagaccagcctgaccaacatggagaaactctgtctctactaaaaacacaaaattagctgggcgtggtggcacatgcctgtaatcccagctacttaggaggctgaggcaggagaatcacttgaacccaggaggtggcggttgcaatgagccgagatcgcgccaatgcactccagcctgggcaacaagagcaaaactccgtctcaaaaaaaaaaaaaaaaaaaaaaaagaaagaaaagaaaaagaaaaatctactggaacttgttggcccagctaaaataccatggctcatctgaagcctttttttgaccctcccatctctcaaccagattcagactgtttcatgacattccctcagattccaacaacactttctgcttcgctatattataaacataccataccatatttggtaatttgttagctcttccttatccttctcatgttaaattgagaattgttcagcaacaggggctgtgacttagtcgctattgtttcacagacacattaggactgcagtgaaactgtagaggaatgagtgaactgtataatcatcacgtctccgtgcatacccgcacaattgtacacatgcacacttttcttttttcttctatctttacattttctttattaatacattttaaaactatttctcccaaatagcaaatatatatttacatgtttctttaaatgatatgaaacttacaatatcatttggcattaacatttgacaaaaatgctatttttccaggaagtctacctagctgttctgaccaaggtatcttttctgttttgtgtatcaatgtcttctccaatgaacaagcaaataatacaaatacagacattgatccatatttatgcaatggcaagtgaatgcggttcactaaggcggaagctgccttttagaaggattaagagatctaatctaaaccatatactttgctggtaatttcagctgaagaatttggtttttcttctttgtggaacgtgtagtaacccagtattgttgttgtcactgaattggacaatatcaatgaaaacactagcagacagtttatgttttgttatattggaaaatgcagttagaactgaagggaggaccaacagggaataatttattgcaaacaacccaacatgaattactgagaattaggcattactctgttgaatactttttgacatgcttttcagccccaaattaaaagttattagggcatattgtgatgtagttatgtatacatcataggtagtatgtagttgtatcccattgtaacagacagattaactgaagtacgagggatagccaattctatagaatctcatagggagaaaaagactcagggaagtattctaactgccttttattgcggatcctaagttatgcttgaatttaagtgattctcatcctcagtcatcatgggttcaattacatttaagttcataagaatactaacaggagtaaattaattctggacatgggcattttggaaccaagttcgcttttctatgattattttactggtgtacattgtgtttgaagaatatagtaaaaaaaaagttggatgtttctgtattgcaaaaacaaacaaacaaacaaacactatttattcatttgtggccaaaggtgccttgaaattttatgaagtagtataaaaagtcaagctgtgggaaaaatgtgcatgggagataaccaagcctagtcccaccttctgcatttttcagtttgttttcttatcagcctgcccataaactggaaaagcattaggcacaaacccactgataagcatatgagaatttcttctagtgtccctcattcttctttatggaatctgttataagaattttggaatccccatttgaaatacaaagagttacaatacaaatgtaaaaacaaattattgtaacgtcagaggctgaaatgcatatgcaggatcccttttgttaatctttggatgaatgagagggagggacacctacctgggaagaaagagtagtaaattcagctcactaccaacagaaatgacagtgaaggactttcttaacattgaggctttgaaggttaaactgttgcatgtcactttccaattaggatgcctgggagtaagcaacagaaatagactcaggcttacttcaagagaaaatgaattcattaaaaatattactgggtgcagcacaccaacatggcacatgtatacatgtgtaacctgcacgttgtgcacatgtaccctaaaacttaaagtataataaaaaataaataaaaaataaataaataaataagaggacaggctttggagccaggctgcctgtatttgtgttaagtttcaccattacctaccagctgtgtaaacttgggcaagttacttaatgtctttgtcctcagtttcctcatctgtaaaggataattttaaccacttcttaggtttttgtgagtgcttagaagcaaccaacaaatgttagttctcaaaaaaaaaatatatatgtatgtatataagttctcagaatcaaagagaaagttggaatttcaggactggaaaatgaacaggagttaggagggcctacacgtttttgaacataggaatgtgttcaggaaaatctgatgaggttgctgcaactggaagccacgtgaatgggcatgcaccacatcacccttgctggatgctgagggtctgctgttgctcttgcgaataatttttcaattacagttttattatctcaaaattcagggtcctgggtgggggcatgacctaaggatattttatctggattttgtcttatggttaaagactgggttgtactttccactgatactcacataatacaaggatcctccaaaatagaaagggaagtcagatgtggagtagccaaataagaggaaaaaaatgtatactaggtagccggtatagagaaaatgggtgcgtggtcattaatttaccatctttaaatgcatatacttattttcagcgtaactggataaaaatgtctgattctttctaaattgtaattatatcttttatcttttctagcaaattacttactactagcttccagtaattaaaaaaaaaaaaatcaaacatctatgtacaggtacactgaccaatatccatgaactgattttggttgatttaaacctgtagacaaccatgagaagtattaatatcacatctttacaaatgagaaaacagactcagagagatgaagtaacacgattgcccaaatattacaaagagcaattgacactgtcaggatgagatctcatgtctctgtgatagaaatttcatttttctacagaaccatgaaaaaagttatctttcagataacgtagctgtcatttcattcactattgactatctctacatttcttagatctctttttttctgtatttttttctttactaaaaatcgtgcttttatttttattttctattttgagttctattgcaatcagtcatattaggcagtaacattttctcctaaattaatgccctcatccattggttttatttttccttattctccatatctgtattaatttgtgtatggttttaatgaaaagtcacattataaaataagatcttgtatttttttaatctttataacctcaaggctcagcacagggcctagcacataggaggtgcctgatacatatttgctttatgataatgggctcgaagaaggaaaataaggcatgacaatggggtggcaaaggaaaagtgaaaaaggagaaagttgggtagagaagaaaatggatatgcaatgactagataaaaccatcttctagcacttcgacccgcataaatcaacacataagggatttttaaataacagttataatattgataactgtttgtctcctgtgggttccagtttatttctcggggcctgtaaatatttttcttaatgttttcaattaccaaaatgatttattcatcacgaggtcttctcttatgctaaataagttttatgaactgacatagccaagagaaagtctgttattatattccttatattccatttattggagttggtctttttgctaacttttatctggtatccatttatctcctaaaaagcgtggattaaaagataaggctttaggactggtaagtgacttacataattatgaatttaagacaaagggacatatttcatttctttgaaaatgcataaagtgctgcaaaggttttaagaaataagaactctttgaaagggcttcctgatatgaataattgcaaatgtcaagggatgagagtttcctgatagtgattctatttctagaatgtcaggtactgatgcaaaggtgacatgagtgatttgaatgagttgttctatgtctcagagatggtcccatagagaaatgaaagcagtgctttataaccaacagagagatttatttaagaccaaaatgtcagaggtaatcaaactgtttaatttgtgctcatagttttgctttgcattatataactggacacacagaatttattgtatactgacaaattatggaaacagaattttataaaaagtaaagttgaatgctgcattgtggctttcagtaaattttgataaaagtctttatggtaatattcttaatgaagtataaatgctgatatatattctatataacatttttccttttgctttaagtttatattagcatgcatgcaacaaaatatacagaactgatcctcgtgaacacttccatgtgcatggtgccaagtgcagaaacaaaacatcgttcacactattgaaaaacctgtattctgacacctaccagtaactatttacccacaaagataatcattatcctgatttgtaacatcgttattggctatcacaaatagcattaccaagaacatttttgtatgcgtcttttgatacagaaatctatctatctacccatataagtttctgttaggtatataccttagagtggagttgctgagtcagacctatgctcagctttggtaagaactgtcaaaaggattgacaaattgattgtaccaatttattctcccaccagcagtgcacgagggttccaattgcttcacatccttggcaacacttattagtggctctctttttcattttagccattctaattataataccaaaatattttgtgtgtgtgtttgcttatatatactcctactaccaaaagaatgtaagtgacataaatcaaaataagcacttttcatttatcaatttatacatcaagattttaaagagtaattcctccagatggtttctagactaaaatgcagcatattgcttagaggaggaaacttttcttcaatattcgatgatccatctaaaaatatgtcttaaatatttcaaaaatttatatttattaaacaaatataaaggttttgcaacagcttatgtagatgatggaattcaaggtgtcttattcttacaatatctctgataaaaaataactgtaaatgtacttatatgttttaatatggtctatatgataatacttttttatttattgaaataaaatatagcatgttggaggtttctatgtgaaatagaaacctaatagtgattctgtttcactgaagaatttccatgtgtctcatttatttccaaaacaatattacatcaaattaaaagacaaatatttagtttattctaagatgtgttcttaaagacattgataaactggcatgactaaaaaattaaatgaaatcaaatttttacctcataaaacaaaaggtctaaggttccagataaattttgaagccagtgttttgtcaggggccatggtaaggctggaatttgggtggtgggccgggagccaaaaagagctgaggatatggttgctggaatgttcaagttctattaggcagggaagaaggtgagaacttcataggctttgaaagatatgcaaccagtgctaaaaagagccgcagtgattgactctggaaggtgaagcttaggattcaagtgggagatactaaaacattggcattggaattcacaaacattttaggcatgtacatttaagacatatgttaggaatcatgactccattttgccaattataattcctgttaggcagaatatctgaatcattcttctgccagcagtcccccatgtccatcacctattctgtaactatcaccaattattttccccaatattttcctaaagctgattaaacactcttgggtcataagaaatttacatttgtcaataactgaaaaaagttggttcaaactatgtgatctagccttcaagctgccctatggttttgtacaaatttaacctttagagcaaccatatcatcatatgtatattatcacaaaaattaatgttggtactttattcataaacatgtataatttacatacataaacttgtataagtcatgtacaacaataaatatagtgactaatcatcagggaaatgcaaatcaaaactacaatgagataccacttcacacctgtcaagacagctattataaaaaaaaaagtgttggtaaaaatgtggagaaattggaactctcatacactgttcagtatacaaaataatccaggtactatacgaagacagcatgaaagttcctcagtaaattaaaaataaaactaccttatgatctagccgtgccagttctgggtatttattcaaaataattgaaattggaatctcaaagagttattagcactcctatgttcattgcagccctattcacaatagccaggatgtagaaacagtctcaatgtccatcaacagataaatggttaatgtgccatatacatgcaatggaatactatgcaggttttaaaaagaaggaaattgtgcaatatgcaacaacacaaatgaaccttgaagacattaggctaagtgaaataagccaggcacagaaagacaaatactgcatgattccccttttatggggaatcaaaaatagtcaaatacatagattttaagagtgaaatggtgattgcaaggggctgagggagaagggaaaatgggaagttactaatcaaccgacacagaatttcagttgagtgagattagtaagctctagagatcagctggacaacattatacctacagtcaatgataattcattgtacgcttacagatttaagagggtagatttcctgttgtgttcttatcacacaatttttttaactctttgcaatattttcctagccttttctgcttgactacctgctttccacttctgtaccccactgtacctcctcccatattaaaaggcaaacacagatccttccatagtctcttcatgcttttgtgtatttgtaaaatagagtcatgtatcacttgatggggatatgttctgagaaacgtgtcgttacgcaattttgtcgttgtgcaaacatcatagggtatatctatacacacctattttgtatagcctactaggaataggctatatggtacagtttattggtcctaagctacaaacctctaaagcatgttactatattgaatattgtgggcaactgcaacacaacggtatgtatctttgtatcaaacatatagacacgtagaaaagacacagaaaaaatagaatattaaaatctcatggaccacccttatgtatgtggtctgttaccgaccaaaacattgtaatgcagtgcatggctatattgtacaagcaactatagtcatccatttttgtactgtttcagtaaaggtttccaaatgggaaaacagatattactctagtggtccagatagaagagatttaatacagataattgttacaaacagtgtcgtaaaggctggaggggccaaagtggtggtatgcagaacctgtaaacacatgttgccgttatcaaggcaggaccccgggcttacactcccgtcaccactgccactgaggtcctattgctgaggctggtgtgccagagccactgccagaggcttccggtttctgactggtagagctctcctttttttgcagaaagtaactagaagtcaactagcaaagaagctgagaagactattttgaaaggaagtcttagaaatgtaaatttcaggctttctaaccacccccagtaataaaaaaccatataggggcagcagcgggactgacgaccaacagacaacctccaatgtttatgtgtcggcgagattactgatagtataaatttatgttagtattgtcattgtctggtatacaaagatgggcttccgtcgaattctttgttgtttttgcttttctttggttttctctcttgcttttgtcacttgacgatatctcagtgaaatttttccaagtcaactttattcttttccaagcacaaatttattctcttcaagtcatgaatgttattatatggtgtggatgaatagtaatccatccaggcattcgattatgatgagttttcatcttgactctgacaattacgaagagttttcactttgactcttctttttagttgaaataaacatcactgctcattgctctctgcaggttggtgtattttgttgttgttgttgttgttttttgtttttttttttttttacacggctaggtcccaggtttaggattgctggtgagatggaatatgttttgtttgcaattgccattttatattcccaaatgggaataacacattataatttcacaactaaattagaaaaggacagttttcactgcatccctgccaccaataggcattatctgggatactttcttaattacaattttatttcccagaaagcaagccatggtggaatgaatgcaaatactatcccaactccagtgtaactttacagatctttccaaaccattataatgcatggagatttttgaatcattcaccattttcaaatttaaaattgtcatgaaaattactcaaatcagtgaaggcagaatagcgtttcagtaatatttcagctaaaacaagtctaatgtttaattatgtatcttttattttgtgtttttattttcttttaagatggctaaaattttgtgagagtgctgctattgtaggtttgtatctgccattgtcgcaggttgaatcacttatggtaagctaatttatattgtaactgcattccaactcaagatcttcatagactttaatatcaaattttcatttcttgccacatgttcatcacaagttgtatgtcagtgtggagagaatctgcctaatggctcttcacccagaaatccaggctgctaggtgtccagcatctggtgaatttgctggtagttgtggcagaagagaaggtggcaaattaaaaattgactcttaaagacttctgcccagcagtgatgtatattgggtccaatcatttgttaatgagcaacattgactaacacattgattcgaatatcccttgaaacatttatgacatatttcctaacttgacataatgcagcacatagtatttcaattgttcttctatttttttttgtggtgactttacccattttgaattattttatgggtagagtaagaccattgattttgaaaaactggaagttgactggctctgcaaattgaagagttagctggtaaaatagctttccctttttatttgttgtgctgcttaggtgttgtgtttgttcttgcattgctatagagaaacacctgagactgggtaatttataaagaaaagaggtttaagtgattcaaggttctgcaggttgtgcaagcatggcatacacatctgctcggcttctgggaaggcctcactggtgtttactcatggcagaaggtaaagcaggagcaggcatatcacatggctagagaagcagtaagacagagtggggtggtgggatgccacacactttcgaacagccagatctcacacgaacccactcatattgtgaggacggcacccagctgtgagggatgcatgcccatgacctaaacacctcccaccaggcctcatctccaacactagggattacatctcaaaatgagatttggcagggacatagatctaaaccatatcaggcgactcactgaagaaaataatagtataaaatattatggcagtttaatcaataacattaggataaatagcattagtgtgtgtcatattttcattgtgattaaatctaaatgcagcccttgatcattgtcattggggtccagtttaatttcctcagagtgctcagacagtacctggggatacttgcagctctcaaattgttactaatggttagagttttcaattatttttgaaacaaatacaactcaaggataaactttgataattgaaaagggattaggatgttaaaaatgcacactttcatgaagacagctacttattttttatccactgaagaaaacatcttatggacattctctcatattacagctttcagtggcatggcattagaattctgattccatattgcttgttcttctacattgaagcagatgtcagtttcatatggattctgagtatccagtctgtcaaatataaatgtaattactggtcaatagttttggataatttttacatctgttgaagttgtggaggttttattaattattttgacttagattttattcccttcagaaagctgagaattcagaaccatattactttgggtgaggtcacctccactcctaataagagcaatatgtgctgagtagtcccggtgtgcatgatctgtgctgttatgactcacaagtcccactagaagtttcaggtacaggaaaggaatttcctccaaataaggaaaacgttgtgcacctgtgttgtatactgtttgtgaaaagcaagaggatgtagtattggaaaggtgtaaagcttatgctttagttggctagaacaaagttcatattttttctcagttatcaggggtcgtgaaagtcattaaatccaacttctatccagtgttagggaatctgagaggtaattctcaaacttttgcctaagtgtgatccacataattttagtaataagcttatttcctatttcattgtctcacctgagaactttctaactgaggtggaagcaataaatattatttgttaatagctctctcctcctccatgtcccttgccttcctactattaatactaccactattgctgctactgttctgctcctactcctaatacatatttaactaatataacatgtactctaccagacaaaacgttgggataatttacatatcagctaaagctgtagaggcttcattttgacttagagtttgttgcctccaacactcttaacattgtgaaccaggttatcttgtgtacagtccaccctgcttttagtaataccccaatgtgctatttattctgcattcatcatctcatttactcttcaccacagatctgtaaggtatgtgtgagccttattcacattttataaagtagaggaccgagatttagaaaggttaagaatgttatcaaggtcattaggattttaaatttaggctgcctggctataaagtccacgcttgtaaccaccctgcagtaccctcctttcattgtttttatttatttttaaattcttactctgatattgagattctcacctgtggtataaaaaagatcctgttgtagcggtggaattaataattaaatacacccacctgtaaatgcttgttaaatcaccagaattaaaatagaatatccatgaaatgttctagatgttcaaattgctcttgtcactgtgcacaccaagatttaaaacctagggcctcgtaagtattcagacaattgtcttggaagatcttgtgttttctctatttgctactgtgtgttaattctataccatgctaggatacaggggccctatgccatctttcaccttcttagtagaatgtttgatctaaatagcaatttggcttgccctggacaatgttgtgcttcccctaaccaaagaaacatggttctctggaagattatagtaccacattggtcagcagtttcaagtatttggcattgaagacattgtaaagcgaattataaataattttatcctgaattatctatatcataggcacattgtgacattgtttagtttgcaccattgttcctgttgttggggctattgttgatattattttggcagactgtgctatgttcaaattaagactctctctggaactctcagttataaggttattattattgccgtactatttacaaaagagttgccaagactggtgcactggaagctgtgttccacttatcaattcaaaggaattttagtatcgtttctaccatcagggaatctgtgagctgagctagatagaatcagagagattatctagagattattttattgatcaccaaatgcatttttgtaaaagtaaagaccccaaattgaagctcttcaaacagtcagttggtgttactaaaatggcttatagttacagttatcagtctcttgagtaagcaaaatgttatctcaaagccaaaacaattttgtggtatggagagagattattaagtagttgaaatattgttgctgaaaatatggatttaaaagcatcaataccaagtgccatggaatttccaaatgacaacttgatattgatacaataaaacagaaaaagccattaataattgaaagcaataaaaacatatgccttgaataaaaacaacttgaagcccgtaaataatacaacatggctattcagtgatcattctgtaatattaaagtttcaaaaggcatcctaacgtgttggattttttgtttgtttcacatttcctgatccagatttatatttttgaaaataatatctactatcaacctgatataaagagcagttcattgcgactgacatcttctggaaaagaagaaataatttttaatgggattgctgactggttatatgaaggtgagttgatcagatttagtttcaaaggaaacaaatgacatatttttatacaaaatctaccaaaaaaaatctattcattccggagcaatacttacagtacagtttcttctcattttctctcaaaattgccctcatgctttcatatctttgcatgtgcttatattttgtgtggttgagatttacatctacttacatgattccatgtttggtgtatatatgtacatataggctagatagatattatttgtgaggacaactaatgaaagtaaatggttaccttatgtcactttggaattagatgctgaattttttctgactctctgggaaagaagaaacagaaacctttatttctaaaaaaaaaaaaaaaaaatgcataaaaagccacctgattttagttatttccattagggacattctgtcacactttataagctattgcagagggagcaaaataaaacccacataaagagttattttcaatatctattgaatcaagttttagtaatagctgagaatataaaaataaatcaggtgatgaaaatttatccagtttttatcacgtaccaattatcagctgagttctacatatagattgcctgggcaagactcaaagtatgagtttattacctatgtttcagattcttcagctgattttggcaaaatatgtcaagatttaaagtaagtctactttattataaattataaagctatgaatcattcaaaaagtgaattttatttcatgggcaatatttgcaaatgtaatctctctacctcagatttgacatttttaattctataagaaaagtgaataacttagaccaattattcattcattcactctttcactcaaatgatatcattgaaggcctactgtattctggatagatgtctaggtgccaggataaaagacggagcaaaaagtactgctctaataaaccgtatatttacgtgaaatattttgttaggtggagctattttattaaagaagagatgttgtaacccttgagatttatatgtatatgtgtacatgtatatttatatctataatagatttctgtgtacatgccagcatgaaataagatttttagaggctacaatttattgtgaagagcagtgagagcttccccgaaaatattaacaataagtatgctgtgaaagtatatattagaaaaagaaatacacaggtaaggagtgttcattggttgagagttacagaatctaaatctggcttttctatttcaaagagatacattactggaggggactgggatggccctcagaatttaataaacaggtggacaacacatttaaaatctggttagttctggcagtctaggtagcaggagctaattgaagtgcagagactaagacgtgccctttttcttcaaaatattattggtactgtgtgacaccctgacagatgaagaaaccatgttaatgcagtgtggtaagtagttgaatcttaatcaacacagaattctatggaagaacaaaggaatgataccattctagggatttgcaagcattttttctaaaggagaaaccctggccaacaacagtagctcaagcctgtaatctcagagctgtgggaggccaaggtgggagaattatccaaagccaggagttccataccagcctagacaaaatagcaaggttttcatttctactaaaaaatttttaaaaattagccagatgtgatggcatgcacctgtgttcccagctgaagtgagaggattgttaatgagagaggattgcttgagctcgggagttgaagactgcaatgagctatgatccaggcccctgaactccagcttaggcaacagagtgagatccttacctcttaaaacaagggagagagagaaaaagagagagagagagaagagagagagagcatctgagtcaagcctgaacagttaacaagtgttacgcatgagaagaaattaggaaggaaaaatctaagcagatgtaacaatttgcaaaaacccacaagtgtgtccctagggaaccaaagtctccttgatataattgggccataaaatttgagacaaaggaaggtagcaagaagcgagggatagtgacctctatcaatgatttggaatttcaattattttcctaccatttaataggaaaactaatagaagttttcaagtaagggagtgacaagattggatcttccatatgaacagattgtttttgtgacagcaggaacctggggtctaagagtggaaagaaacggtgagcggctgtaaggcttcttctatgttctatcaagagataatgagcaatggaactagggttaaagcagtaaaaaggaggaaagactctaaaattgatgagacaatgaaatatataggtcttagtggctaagcagatggggtgaatgataagaagtcaaggatgattctgtgtcttctggtttgggtcactagtaagtagtggtggcagacatagtgagcaagcattaacaaggagcagtgggtttcagggaagagaagactagattagcagcaatgcgggcattgaaccacgtactgacgtgctcccttggtgataaaaggtggtctgtaacgtcgatgaagttttcagtcaactgagggtatactcaatgtagaccatgcttattgtgctgctccgtcccgaattaagatgacttgggtctctgtcctattgaaaaggcttcatacatttataaggaaattttaaggagagaaattagagaccgtttcctgacaaatacggtaattttcttaactaaagaataaaaatctatgtattcggtctgagagtaaactgtttgtaggggttgtggagagcagaacaaacgggtaatacaaacttttgtgatgatgctgtaggtctgacgcattccaaaggggaaaggaaaaagtatagtttttgccatactttgggctcctatgttgccgttaactaggaaatgctgtacgtgtatgtgatttaatcatcaaaatgtttgtgcatctaatcatttatgaagaaactaagacgcacccagtgctgtggctcatgccagcaatcctagcactttgagggggcgaggtgggcagatcacttgagcccaggatttcaagaccagcctgggcaatatggcaaaatcctgtctctactaaaaatacaaaaaaaggctgggtgtggtggctcatacctgtaatcccagcattttgggaggccaaggccggtggatcatgaggtcaggagattgagaccatcctggccaacatggtgaaaccccgtctctactaaaaatacaaaaattagctgggcatgctggtgcgtacctgtaatcccagctactcgggaggctgaggcaggaaaatcgcttgaaccagggagttggaggttgcagagccaagatcatgccactgcactccagcctggtgacagagcaagactctgtctcaaaaaaaaaaaaaatttaactgggtggggtggtggggtagcacatacctgtgttcccccctactctggaagctgaggtgggaggatcacctaagccaggaagttgaggctgcagtgagccaagatcatgccactgcactccagcctgggcaacagaagcgagaccctgtctcaaaagaaaaaatttaaaaaagaaaccaagactcagagaggatcagtgatttagacatggcctcagagctaatgagtgggagagccaacatttgaatgtgtgtcttttgttcctaaagccagggcttagtcactagtctactctacttgttatagggggatgtccttcactgttccccaagacacaacacacgttttgggacctaaattgtcagacttcagtgatctgtttcctcagccaaagactcatcctactgtccatggacttactctaatcctcactgcatttccaggaggaaccctacccatgacttcaatgttaaggtttggcagagggatgtaagctattcagatgtttttgattttccctcactattttgactgctacccccaacctctgcttcaagagtcctacatgcaccttaccctcccactatcaccttgcttgtggaatgtgccaggagctcccaagctccagaccttttttttcccctttaatgcactcactgaaacacaatgatattgcctagggaatgcatgtaatttcaacgttatgtgtgtgatactctggtgtggagatttcctttttattactttacaggagtcaattacaatctaaattagcatgtatgggagacacagaaagtaacatgtaacatttcaacttttttaaaattgaaatttaccttttgtaaatgtcatagaaaaaaaagatgagagaaagagtgacataaaagacaataaaatatttttacagtaagctttacaggcatgtcttaatcttttaagaccaggccaatctgtaagagtggctgctgcccccaactagtcactaaatagagtccttaaaagtgtcagttttaagaatctttgtctctatttttagtattgtttagttcctaaagaaagtaaagcaatataaagtataatgcattttaaacagcgaagtcagaaaaataagaaaatgctcaaaaaggaagattatttaaaatgtaattcgcacaaaacacgtataatgttattcacttaaattgctgtatttaacctagcaatgtaattaaatacgatatcagatcaaagttttactttaaaaacttttaaaatgttactaaaaagaaagtttacagctacccacttcacagctttgaaaatttccataaagcatttaatctattaaataggaaaaaaaatgactcactttcaaatatttaagcatatagaataatggaactaatatgcttaagtgatttacagatatattttagaaccttgtatatttaagggattattccttaaagtttaatccaacagctgtggagcaaatatacctgccaggcattatctaagagcaatacgatgagaaatacgggtttccatgtcttgggtatttccaacttagtgtagtgataaacaataaacaactattgtattgggaaccatttggagcatagtaaatataaatataaataggatttatttcacatactaaatagaattataagtagaactaagtttgataggatggaggaatgtcaggtgcttcatagatgacatgggccttgtgttggtattcaagaatgacaagaatgaaaaggtgcggaaaaattcacgagataagcaatattcttatcagcagattctgattgttacactttttttgttgaaataaaacagggcaaaatgcctattttcaccttcatgtttgtttcacattaatgtttcacattaatgtcttttggcgacatgaaattgcattcatttcatcattgattcaacaaatatttattgagcacttgctcagtgtcatctatggggctgcagcatgggagtcacaggaaggcagggttatcagtagtgctgagtctccagaggtcaaacaagggaaggattccaaagcttttgttggatttgctcatagatcatcgatggccttgacaggagtaaaatcagttaattggtggggccaaatccaagactgcagtggatggacatgtaaatggggagtgagaaagttatgaatagagactattctttcaaggaatttgacagtgaaatgcagaaaattgaaaaaaaaaaaaaaatcaaccacaggcctgcagagctgcaagtagcatcctcaggaaatcctactggtctgaactgacaaactaaaaatggaaaaaatcagcttgctttttacaataacacattaatctaaacacaatcgttgtatctcagtattgtggaagtgctttgtgttgtggctatgtttttaagtgcctgtgatataaaaccacatgtgctgaaaactccatctgctctgcagtgagattttctaaatcagagtaataaaaacgatgaagagccaaacgtacactaaattggaatgaaatgccatttgtaaaaataaattctttgtaaataatataatataattaacattggaagtttcaatccatgagtaaatgtgcccattagttgcagttaaagaagcttgtgccttatccaggatgactgttaagcaaatgcatattaaagattattttatttaccaccttcccattccaggtagctttatctttccatctgaagaaagtcacaaggctctctatatgattattttggtacattagcatttttatggggaagaacattaatcatatgtcactctaaaataaatgagagtaggcgatgcctcatttctcttgaaaagcgtactcaaatttgggtcaggtttattcttgggaagtactggacacacatatttcagcacctacgacagaacctgtttcttagaaatctagagtattgattttagccaacggggtatctttgtatcttcaaatctcatagaacttagagtttacggtggggccgggcatggtagctgacgcctgtaattccagcactgggaggccgaggtgggcggatcaactgaagtctggagttcgagaccagcctcgccaacgtggtaaaaccccgtctctaataaaaatacaaaaattagctgggcctggtggtgagcacctgtagtcccagctacttgagaggctgaggcaggaaaatcacttgaaccctggaggcagaggttgcagtgagccgatatcatgccactgcactccagcctgggcaacacagtgagactctgtcttaaaaaaaaaaaaaaaaaaaaaaaaaaagaacttagagtttacactcaattggcccttagcatgcatatatatacacacacacgtatatgtatatttttttctgaatgtgtcatgtgtataactcatgtctccttaaccaaattgtaagttagttgcataaatcagtgtcaatatcacaactgaagaaaggtggcacgttcaaaagggagtaattcaaggagtttaagctatgaaggggccccttatcatgaacaaggtaaatgccacaaccgtggcttgtaatgatttagccattaacagccaaagggggaaggggacacagcagtcacctgaaactaggagagaatgctatacaatttttacagaaatagaagcagtggcttttggttgggcgaagccaaactcacataatttggatgcatgggagataagaaaataaattccacgcacccacttcctcccttcatttgattcgccagggtttcatagtggtcatacccaagaaaaagtcaaagaacataagaatattcttattattcaaattaaaagctagtgtcccaggaaaagaagtacataaaatctcatctgctattgtttcattgcaggatggtattagtcctgttatatatctgaaatctgtaaacatagccaccacttgtatttttcatagaaggttgtggagaaatgcccccattaataataataataaaaacttattatgtgatcttagttagtaattacagttgccttcttccaatgttcatttcttttacttttactttctgtcaggatgctacagaggttatttaacaggtggatcaggccaaaatttcattcctgccaaatgttactcctttccatccttttctatttttttttttctttgacagagtcttgctctgttgcccaagctggagtgcagtggcacgatcccggctcactgcaaactccagctcccaggttcaagagattctcctgccccagccacctgagtaactggcattacaggtgcccaccacgcccagctaattttttttttttttttttttttttttttagtagagatgcggtttcgctatgttggccaggctggtctctaacccctgacttcaggtgatccgcccacctcggcctcccaaagtgttgtgattacaggtgtgagccactgcacttggccccatccttttgttaattatgttgttacaatttcagttttccatcgaccagtactattgggcaaaaatgtatttgtgactctcctgagttccaaatgtatttctccttgccctcctttgcacagcaaacatatttttatttctggcagatgaggaccatcatcagacccagcttagtaactgtgttttgtctttttttgggggagttgcataatgagcccacaatggtggggagaaaatttccgtttccaattcagaggaatagaattatgactatattcctggtggataccctcgtcctttaggcaatggacttctaaactcaccaacttcaatattatgggaataagaagcaaattgtgttctgtgggttattgctgtgataataaaagataacactactacttctaccccttagtgcctagatctgtacctcatggctatacaggtggggcacactgcatgttaaaggatgacatcccggcttcaaggttattgctaaacaaatagtgccaaaactgaggtagagcagactattttactcctctatcaatccaagtacatatagctagtggggaacatgataaaattagtaaataccaccactgagcccatggtgcttttttgccacaaaatatttccttttttgagataaggtaatgtggattattatggtaatggataaatgtttctgtaaagagtagtgctgaacagatccattggcagcaaaagcaaatccatgcccagaatatgtgtgtatctctgtgatgacaaaatgctacactgtcttgatggaaaggttttcatataattcatgtgccttcctcattacattatctcaaaaaaggaaatattttgtggcaaaaaattcacgtgccatcagctcttcccctgagaagtgatcctatgtcaaaggctcagcgatggccactaccattggcaggtaatggtgggagccagaggctgacggacatgtacttggcagtcatcttgtcctaaatttttcccctttctagtaagtcgattcacttgtttttcctaaacctccctgtcactagttttctaattttacttttgccacatccctgataggtggacccttattagttactgcacttgagtcaggatgtttccatgcctgaaactaagtctcctaccacgaacagtggacaacgaagtattctgttcaaaatcttaccaactgggaagatttctgtttcttattgtctttcagtgccactcctgagtcagattctagtatggagcctacccaattccagctcgttgttgtacatcctgcagacctgccataaaccaggcccgcgtttatttctcccttgccaacttgtgttagaaaacatgctttgtggcacagatgtgagatgaggagaggggatgaagcagagaaggcaatacaatgggcaatcacatttgttttctggctcaatttcacttttattttatagtggaatggtgtgtgtgtgttcagttctatggtcagtggatcagatagccatcagttcatgatgggcagtttgggttgcatactcacttggtatcccatggtgaggctaaatgtttctcctggagccctggaaagagctgcccttgaaatagataatatttttcagtacaagcgacaatgatcttttttcaaatcttgtaatgcctgtcctatgattgtcatatggagagtcccaaaggctccacacagcatctctatttgccatgggcactgacattgccattggatctgctggagtcacaaggttcaggacatagaggaggttgcaacatggcctagatcagttgcaaggccccctggtacactgattctactcagaactagcagttttacagcttgcctgggatatagaacagagaacatatgtcaatgcggcttgtgttgttttcaaagtccaaagaattcaattcctctttacttttacataagtacaattgtaacaaattttctctgactttagaagagatatcccggtgtatcccaaactactagatttctagaaacatccccggtgttgcacacttttaaattttaaagaaatttgtctccctttctctacctctatgcagaggagttctagttccctaggatagcggttgcctctgtcagcaagaagatttgtcagaattttgatgttcaatatcttcagccataaaattaaccacatacagcagcattcaaccataatgtgttatttataagattggccaagaaatcataactatactgtatgcttttgtccaaacattcttatcctgtgtgttggggtcccaatccatcgttatgaatatctttgtcttaccctaaaagagcaaatggagttgagcctctaatatgtattgcagccgtgtacccgttcctatgttctcttggactgtggccatagtttccctgcaactacagaagagatggactcttccaaagataccatcgtgacctttggttttgcatgggcattcctgatttcacaatcatggtttcaagctttcttttttcctgtgtactatctgtggggtgtcagaagaaccatgcgaacttgtttcctaatctttacatcatcattgttgtagcaagtaagtgctacaacacttacttgctataactagagatgctgtgtggagcctttgccactctccatatgacaatcataggacaggcattacaagatttgaaaaaagaccattgtcacttgtattgaaaaatattacctatttcaacaagcatttgttctcccaatgccttttccctctacctgtattttattccatgtcaccaccactgatgattgattactcacagttccgtctcttgctatggattgtctatgctccaattcccacttgagaaggtgataaattccatttgtatatatagatagagagatgacaaatgtagtctcaacatctaattttgagggtctcttctgagtctgctgctattattaacttctgtatctgtcagagtcccaagtgttggcacattcaacaagatgctttgaagataattgatttacaaagtgaacattttattgtctttttatttacaaggagaacatttgctgaggttaaggggtaggaaaaccacaaaggaaagtgatgtaaactaagctagtagcagccaagttgttagcactcctatgaccatgaagatgagccattactagacacataaggagaaatttgtgtagaggtggctgcagtgacagaagtagtgacatcatttaaagttcacagccagcctgaggtaacattgtaggatagagccaagagaataaataacctgactttactctcctctttctaatctcctgccaaagggaagccagaggacatgggggccattttgatgtcgttcatataggttagctttctggaccagaaagcgggaatcaaaaaagtggatagtggatcttgaattaaatgaaagatacccagtatacttcttattccattttcttagagcttaaaatagtttgatgaatctagtgggccctcagtttggttgatgatggtagaatgcaaatatgattacatgcaaatgtgaatgaatcatgacatggatatggttttaggccacatctcactcttcaatcaccgttctcattctgattactccagtagtgctttcatctgttctgtctacattgctgaaaatccatgaaatcctgacttaggtgcttcattgtttccttcctctacagctgcttgctcttcctggaattaaaagggtgactcagaattagagaattttcagggaagttaataaaattcaatacacagtctagaaaatataggtgtacaatggagatttcaaggacagatgtttgtgggtcactgagcccacatctctacagttggtctcaaataacactcatttattctagaggaactcctgcattctcacatcgcccactggtggtcaccagatggagaaagacttgccttcctgatgataaatgactctttggtacccaccatggttatccctcggtttactggagcgttgtatcccaaaggaaagcagtatccgtatcctaaggtaagtaacatggaagtactattttgttccttctctctctctgcactagtgacttgacagatggtattcttggttcttgaacaagttgtctttggaggaaaacagaagttttccttacttgtcagactcatcactttcgatctcccagtagtctatacacagtgcttgggtagagagaggtagagatgatttgaaagtgtgtgaactttcacttttgttgcatttctttccttttgatgctcacttttattttttcacaccttacagttgaaaggggagagagaagcaattgggggtgtactgaggccagggcaatgttttgtccaaggcctattccataataggtgttacaaaggaggggaaagtgccatggtcaaatacattggaagttcttaaaaaaaaatctagcttctttcagatgatttcttagagcacttaatgtgctatatgttaatgtatattataaatcttctataaaaaatagactatgcataaagaatctccagtctgaaatagattaagcataaagaatctcaataaagaaaggaccaagtataaaaaaatcacccataaagaatagactaagcagaaagcatttattagtattagtatcaatatcagcattaccttggcagagcatactctagaacacactatataaaatgctggtatggagtcatagccatggttaggtaagacagatggaatttttcatcaggtgaagaaatatggcaatatgttccagacagcaaaactattttcaagtgttgggcaaggcctctataagagggttgcaaaaacatctggattgtactgttttttcctctgtatgccatctttaattgctcgagatctcttttaaacatgtattttttcccaatgtttatataacaaagaagaaggctcatgtgtaaggcccccagtatattaatcatgtaaagaagtcttatgggaaacgtgtaaaatttctcttctcattttagctcctaattaagtaagagaggatgttgatctcatttagaagccatttttaagccatttctttagtgagttgtactttgtctttttcaagcacaataggttttctgccgtttaattcatgcactacattagttagacaaactactgggtaggttcccatcaccctcattactctagccctgtcagggtgggggtgaggtcatttacactttccttctgttcccaccagccaccatattcattttatccaaaggcaaaaaaaggaggcttgaatattgaggatcagaaataaaatgagcatattcctcagtgagatttctcatccatgttccttccacaggttgtagtattaaatgcaagattataaagagtatgattccatgattttaaaatgtgatttatagggtcttctctggacatagattagaaagcagatatactcagtgctttttaggagaacataatgatttaacttcacaaaaaaaaaatactaagagatttttattgtactcaaagaaaagaacttctgctttctccaattatagatttagctttttttttttttggcatgacagtttggacctatacagcataccagcactattttttcccccagagaaaacctgaaaagttgccccaaatatattaattctcacattgtttgatttatgataataaatgttcacctgacaatttaaatgtgaaatggagaactagtgacatactgtgaaaggcacattcaactgttcagtgcactgcacaaagggaatacaatcacatctgactgctcaacgcactgcacaaagaaaattcagtcagttctgtggaagggacaactgtttgtaactgatttcccaaaagaaatgggatttttttttattcacatagtaaaaccaaatgcattgctgcatgctcaaattgccttcttagttctagactcatggtgcttgaacttggccatgcctaggcctcataattttgactagattgagacaaacaaacaaaccaatgggagcatttgaggaaattaaattatgtcagcaataattcagaagatactggatatgaacctagatactttatcatttgataatgtcttctaataaattaatattgcttaatagtaaagataggcgtaacataataatctttgtttattaattgtagaaatcacaggtactaatgataaactttatgttttcagggagactttccacttgtttgtttttttcttatttggtctttatcacaattgtctcaattttacaaatgagcaaatagattctgaaaggcttagtgcttttatacaagtcacagttattttaagaacagggaaaaaactcaaatctattgatttcatccctctctataaaactcccacaggtcaacaatttgtatttccaaaaacacagctggaatccaaacatctccttgtcaagttaacatatacatatggagctctgtttgctccatttactcctaatgacttagctacatgtgggtgccattcttagcctcaaacctgtcattttatatatatgcaaataatatgtataactatatatgataactaccattaatatttattagaagtaaaaaacatatgcctctaataggcaaagccaaaagaaagaatttccagtcctcaggtgatttttagtaggaagacctgctcacctacccaggtacttaagacaataggactctaagaaaataatctgttttggtccttgttcttaaaacaaatttcagtatcattttgggtatgttacgtcaattttcagattttttattatctactctggtttcaaaaaatgttttgttagtttttgctgtaacaaatgtattgtttcaattcactcttatgtgataaactttcaaaaagtgccactttggaaactgaaacaacacatagagtttatactaaattgtgctttaaattaaactagatgaaaatgagtatagcaaatacctaatgtggtcagatttactaatgaaatacagtaaacaaatatatttgtattttacttaattcagcatgattcagaactcataaaataccctatcattagcaattcagcacaaaacagatgcacggttctatcccagtaacctcaggttaatctttgtaattaaaacattatcttgtttaatgacaatctagttgccagtaaaataaggttaattgttattgaggcttgtgtttcagaataatagaggggagaaatttgtggatttgcagtcttcatggcaaatgtaactgtaaaaagcaaatagatgaaaaccctccaatctgcaaactcttgaaattattcaaatattaaaatttacaaatgaacttgcgatgtgtgcttaatttcaaaactccatggaaagatacaaatctgtgattagagaatgctggactgttgaattttggaggcagcctaacgcttagttgagatgttcacgttttgtctgaaaactggccacattgtgtgcacaatttttactttgtgataagcttatagcgctgctgacataaagaaaactgccttaaagatgataactgatacgtctttaagaaagtatgccataaaactgtgcatcattggtaagaattcacagaaagatctaatttaatttaatttcccgcttgctttaatcagtgtatctaatgataaaaaatagaagcacagcttttcactaactggaagatttaatgtcttaacaataattatcattttaattcactaccatatactattttaggcactttacataaatctttttattagtttatgagatattcttatctacagacaggaaaccttcaactcaaaatttctgatttgtgacatattctcaaagaagtgtttgtctcatttttgacaaaataagacaaataaaatgatacttgagaatctttagcatgtgctcataaccatgccaagtaaataacagactgaacatttggactcaggtttcatggacttacacattaagctaagcctgttctcgaaatgtggtcctttcaccagcatcatagggcatcagcttcatgctggaggtggactgccttcagcagtcagtagcttaagaagcccctcaggacctctgaatgattgcgatgctgtctaacttttgaccaccactgagctgttacatagatagatgcataaatagataaagatacagataaaggtcaatgttttattaaaatttgcacactcactatctgggaattttgtaaaaacagatttgtaggcccacactgagagattctaattccaagtctgaatataggtttcaggtggggtccatgaatgcgttgctcaggttccaggagatgctgattgatgctacggtccaagaacaacactttgaatggcactgccaatactgtgtcaggctgtaaagttcaacatacgagacccagctagagaaatggtaggctggtaggctaaaaattgaatagattaaggccgttattttgagggagaaacatgacaactaaattaaaacaagaatgatgtgaaagagagctcataagagtcacagaaggctaaactgcccaaaaaatgttcccgggcactgttgggcttgggagtaatgaaaagatttgcaaattctgatccagaacctttggcgtgcgggaggctcatagcttatcttccaggaagccctttactctatgaaccaatttcataatctctcttaacagttacctcatttccatagtggaaacctttcctgacttctttctttggctcaaaacttctaacctgtgaatgatgtacttccacagatgtgctagtctcttttgatatccaacaaaacatttattgaggaactcctgctggctactgttggcatatattatgttgattctggtcctgatttaactatgggttttgtcaatgccaattccttaaacatggatcttcgtcatttttaaatcagttttattccctttaggttgtttattggattttttaattcaactcacatttaatttcctttttcttttctatatatctcatgtggacttctttaagcatcagccacatcataaggataatggcatattgtttagaaacatattaagtaccttattggtacttaatggcatattaagtctaaacttaatggcatattaagtttagaaacatttggtacctcattgatggggttattcatttattcattccaattgcttgaaatatgtcatgaaagttctcattcctgccccttactcacagtgtatttggcaaaactttgaaggccattgtgttggaacaaacagaaagcgcaatattcgcattgtagttaagaacatcctgggtttaaatactaactttctcagttttaggtatttcacgttgcactgtttgcttagattctccattgtgaccaagagaatgtttatatcttacgactgtagtagggacatttaatttaataatttgtgcaatgcctttagtgcctactatgtgccagaaacgtaccaactactatgcctgctagttattatttatttaatgaagtgttgattcactgaactcaaattaaattatccttgctatccttgcctttctgttcttcatgccaggtactcagtgaggacagtctgcccatggcccacctcccaagggttgtcaattatgcaaatgagtcaccccatttagtaattagtaatgtttaaaaggaaagcccgggagattaatgcgatagcatacattacggttttggaattttaagcacagggcacctggttttggtaggcgtctttctttctttcctttctatttttcttcatttctcctctttttttttaattagccaaaccttcttcccattgcatttcatatcctctaatgtgaataactacttgatctactagtttgtttgtttgtttgtttgtttgtttgtacagccagcccttctggtgccattttagggaaagaacacagaagcactgcctaatgagtgaagtcatcacgatttcctatcacctttaattgtctgaagaaaatgattgagaagcagcaatcttcaaaaacaattgagggcaatcatgttgtcgaatttaaaatcatttctacttcagagaaattaaactttttttcttttctaacacaaaacagtaaatgaatcaaaaatccttttcttttttacccaatatattctaatgcttaatgtacttgcaatacaactttcattttctcaaaggcaggtcaagtgaacccaacaataaaattatatgttgtaaacctgtatggaccaactcacactttggagctcatgccacctgacagctttaaatcaaggtatgcaatttcaatttcacttttatggggaaatagatattttcactccaattatcattttgttgcaatttagagagagatgtgatcagctcaacaaatccacttgaaaataaagctgaagttgcctacattagtgaggaatgaagtcattctcggtctctggctgttcctaggaagcatttagctccaaggtgattatcagcaccatacaatgactgaagaggctgatactgagaattaggtcttttgctggagatgtgacagagatgggaacaaaagatcattttccactgaattttcttcaagaaaatagttgctccacattttttttgaaggtgttcattaaaagtgtataatctctctggaatttgtgagtttttccaactttctccccatagttttgccaaagattctctagctttcttctccagacatttaagaatttttttttcaaaatatcctatgtatgaaatacttatatttaagaaacttgatcagggagaaagtaaacacattttattgggtcagaagcataattgtaatattagcaaaatcttcagtagtgaacaactaattaaataatcatgtgtattttgaaatccatcatggtttcagacttcaaaagtgattctttcaaatactagagtcctttggaaatttatcacaaccctagagatgggataggcagctgatttagaaaaatgttttcacattatattgaatgatgtggggataagttcaaagtttattttgatgatatcgataatcagggtgattggttcccacagaaatttcattcaaatgttgtttcattgacattatttagaaaaaatttcatcccagttggtcattttcacagagagtgcagcctgatgtgtgtggaaattttacgtacttgaaaaggtaataaaggtttatggaatgcttactccagaagaccctcattaactacctaatataaacttctccttctactgatggaaaagataaatcccagtgagagtaaatgatttagattaggggctcaggactcattgataagaaaagtagaaaatgaagtaaggactctttcatcaggttacagagcatttcatccacgttggatggaagaccttaataataggcctgaattggcatataatgtaatacagttgaccaaatcaaatagtaacatttatttctgagcttgatctagcagccatgaatggttacgttacaaatgaaacaatgatggatactattgacattttatctggtccttaactcttatctttttctctggtttgtttaatgctatggaataacagaaaagggaaatagactaggagtgcttgagtcacatgtctaccaccatttcatttgtctcattggataaatcactttacctctctcagggctgaatccccttgtcttttttttttttttcttgagatggagtctcactctgtcacccaggctggagttcaatggcacaatctcggctcactacaagctccgcctcccaggttcacgccattctcttgcctcagcctactgaatagctgggagtacaggcacctgccaccacgcccagctaattttttgaatttttagtagagatggggtttcactgtgttagccaggatggtctcaatctcttgacctcgtgatccgcccgccttggcctcccaaaatgccgggattacaggcatgagccactgtggctggccccgcttgtcttgaaataaaatttctaatttttttcctttcaaaaaaagtttgcaatgggaatcaaatttacaatatccatgtttctttctaaaaggagctcttgattcctgaccttgattttttttacctatttgtataaatataaacatatataaattgaattattaataacatactttcttcatgtcctattaagttaatcaaatgtcctctcttctctttgatgtttgtgttgtgttcatagtatagctacctgtacagtttaaaatactgcctaaactctcaatagcagaatatttaaataattcattttataataatttacatgtttatgggttttttttttttagtatgttacttaagcatctggtatatttttataatctttaggttatctgtgaattgacagccaataagtgaatcatattatgtttctcagtacagttataaactatcatttttttcttttttagtacttttttccaccacacctaaaccacaaatatgatcatctcttagttttcttgtcttaataaaatcgccaaaatgactacaataataattgaatacatatatgattatgtctatataaggaggaataatagtaagataaatatagaaagatttttttcatgacttccactaccttataaaccagattctctgacctccacactggagaacaacatttttttgttgtttgaattgaagatcttaggtcctttttttggtctgtctgattgcttatttggatgattggtttccttatttataataactagtgtttatcactgtaatagaaaaagttccccaagctagtatcattatcccttcaacccaatacttatactcaccaaagactgtaaaatacattttaattaatttatatgatttagaaagaaattaaaaggataagataatctacagaaagacataatttcttctcctaattcttaccctcatagtctcttcaattgttttatttatttatgtctgattcagctgaagtcatttcatcaatttagacaatgagtgcaacttttcctcaataataattcagttcagactcatctcatcaccattcagtttatctttacctgaatcacagtctgtattgattctgaaaagaatgtagcatggtaggaactaagataatgcccctttttgaatatccccagaactagtgggagttggatgggttatctcatcttggaaggaagaaacattttgtcaaattgttgtactgtgcacttaaggtattgcaatcacacaatacctttattagaaaatttaagtgtgaattttaaaatatatatttactttccagggaaattttatcttatgataatgaatcatgaagattttccacagattggataagtcacattaatttggagaagtgatacgtggtcatttgtgtagacctctctagtctgaagagtaaaagtaatgatttgtccttggtttcttcttactctatgtccttagcattattttacttcttagaaatctttctgtagtcacttatcttttgtgacccattgttctcaacctgcatcactgatttaacatggtcattttgcccctgtgactctgggcttgacactgtcatgctttctctccctatttctttaagtatatctagcctacatctcttactcttccaaggagtatctgtgccttccaagaaaatctaattaataaattaacccatgttcatggaagtgtcctgaataacccttctgacaagtaatgcatagttattaacagaggtctttgtagaacgctagctataatttggtcatgaataccatcacaatatacttatgggaagacatcacagattatctagaagaaaatgagctcaaagtaactacaccgcacaaatattttggtgtaaacacagagcaatgattggacaggaaggccatgaaaacacggtgtaactgctaacatacctgtctgcaggtgatgctggggcctccattccacataaccttgtgtacaattagatcttctgtgccagaccacccagctgatagaaagtctgttgacttgagtgcaatccctctaactagcttgtctctgtctctgtggctcaagaggaccagatcctcgaggacttcctgggtaatccagagccatggagactaggaacaagcaggaaacccagttataagaaagggacacttctgctggccactggtcgtggaacaccagatctaatgtgttcatgagatggagttccaggaggacagctacatctgcagcaggcaggccaacgagtgtgacatttccaggtaagggtgcttccctactccctcattcagagacagcctgaatacttatgagtaagcaagatcagtcaatatgaatcacagggagatgtacacctaggctcctggggcaaggaaagaaaggatataggaagtgattgagttaatagatatatctttcctccctgcctatgtgtcaagctctacttgagcttccattttggctatctccaacaccttcatatagaaatttcagtggtttgaaatggtcgtttgttagactttaccaattaaaatttgtggagagctttcattcttcagattgtgtttaccatgtgcaaggtcattcttgggtataagcaaggtttgtaatgaggtatctcacatcagattatgctttgcttatgaccgtaagccacattatttaaaaacagacacaataatcacaatatttaatcaaagagaactataagtatattgctgtaaattaatgattttcaagttaacagtttacaactaagttagtgttcccttaaaaatcagttattcaccacatttgtactcgttggcttttcattcttttccaaagattaagttcttttttttaagtcaaaatttggcatcttagctaataaatatattctgtcatgcctgtgaggtgttgcaaagatgttcttgtagcatttcatttgagaccaactttgaaaaggaaagctctcaagatgaatgtttaaattctgttttgttgttggtggtatttatttttaaaattattcatgttagtttgttacctcatattgcacaaaatataatattatggcaggtaattgagacaaatttctgattatattagaaaagcaactatatatcagttcaatatagagtttaccaaaaaatatgaccttcttgattttgcagtctttggttagttgtttacaatattcaaattaattttttacttcaaatttcaacaacatttatatcaattattcagcatttcagcacttattttctgattatttatagtacttactatcatttttctataaactaaattctctagaaaaatctattaaaggttaatacttcattttctactttttaatattcacattgctaaatataatggtgtatgcaaaataatcggcttaaacgaaacacagtgaaagtgaacaggacactgttctttgcaggatcacaaggcctattgatatggacaaagattatacctaagccagctgcatatttgattcaatgttgccttattaactctacttcgggcactttatgttttgatttcactgagtttaaaggcagttttcaagcagagctcagctagttgtggcagctgccagatgtcttgaagaaattgttgaaaaaaatattacagccttccttgtatgtcaagttatgcttgcccttctactgacatcttcactttgataggctaacaggttttctagaggaaacagtagctactcggtaatgttagatatgtaacattcatgtagttgtatatctaacccagatacctctaaagacaggcaatttgtatcaagaggttatttttctgtagttgatatttttctaagtcatataaaactgggttaattaactgtgttttttttttgttgtttttttttttttgagacagagtcttgctctgtcgcccaggctgtagggcagtggcacgatctcggctcactgcaacctctgcctcccaggttcaagtgattctccagcttcagcctcccgagtagctgggattataggcatgtgccacaacacccggctaattttttgtatttttaatagagacagggttttaccatgttagccaggatggtctccatctgctgacgtcgtgatccacacgccttggcctcccaaagtgctgggattacaggcataagtcactgcacctggccaaaactagtttaattagttttaatacagtacattgatgacactttccgtgacacgtggatggctgtttcttctgagatcagatgagattgggcatgttcaggatggtatggctgtagactggatggctatttctaaagtaactgatctgttctgaaactgggcaagtttttagagaagtttttttaagtttttatcataaatggatgagtattgatgattgcattttgttgcgtgtgagttggaagctttgtgacatattgtatacctgtccaaatgtatgtgttacaaaggaagatatataaactttccaatcaccagttaccatgaggacataattggccccataaattatatctttattataccaagaatttaatagactcccatcttctttaatttgattcatttcttgtttaaaaatgtttcaaataaataagataattaacaatatggaaaaaattatgtattaaaaattgggactggtccttggtctacaactggcaaagaccaaaacaaaccattcataccttggtagccaaagtccccacgtatgaagtgaaataacacagaggttatgtataaaggatataattattaagccaggaataatctttgccttttaactggaagagattattcttgatgattcattgattgtgattttaaagaaaaaaataacatacctttataaatgtatacttgttttgcacttaaaggagtactaatcaatagaaaattttcataaatatctagcatgtcattgttttgatttttccaagaaatacttttctgggaaataattcactctcaaatttgttctcaaattatctgtatatttgtatacatatgtatacatccatgtgaatacatacatacacatatatttgtatttatatatgtaaatattgaaaagagcagatatctatttatctatctatctatacataaattaatatgtagcaacatccttatagtggttcagttattcttatatataaaatggcaaatgtatattgttggtactatatcaatgctctggctctaaacatacattttaattttgtttccaaactagagaatactatatcactatggttaaatgggtaagcaataccaagactgtggtaagatggttaaaccgagctcagaacatctccatcctcacagtctgtgagaccactacaggtgcttgtagtaaagtgagtataatttatttttcttttatgcctaaaatgaagtagcttatgcagctttacaaaggggaaacaggaaatgctttgtacaaaaaaaattcagtgtttaacttttaaaactaataggaaaagaattattctattaagaatatatactttaatttataaagcttccaaactttgaagtgaacaatattgatgataagcagaagagaacaaactgagcttttgaaaaccaaattaatttttatacagcatgaagtataatccaagccacgttagcttctttctcagatatggaatttttctccatattttgtctttgattatcttgagaatataagaagtttctttcctatcttctttaaacatattccttttaattttttctgtagttcagatagatctgataaaataacagtgtttctgtactgaaattaagtaaaacaagtaaaaaattggttcatgaactactctgttttgaaatcaggttatatttcaattcttaataccagtttttgtaaactctgtggtaaattcaatgtgtcatttttaagattcctggtagagaaaacactgcagtaagtttaaacggttatgtgtatggtatttgggtaaagcgtttttagattaacaactgaattttcaaacttctgttctggaaaagatggagtacgtgttacctgactagcttttctgttataaacaactgtaaaattgtacaaaatatacaaaacatctgttttcagatatgggacattaggaggatcatgaccataaatgctgaaatcaagtaaatgcacaaaatcaaccttgctatgactttctattcacaacacttttgagaccaaatggcaaggagatggagcccaagcaaagcaaaaagatttttgtgatctaagcagacagggagaaccagcgtttgaggctttttttggtgactagcatttataggacagggaccagagaagttggagctttatagaaaaggactccagcaatctatggagaggaccccttaagtattaggctcaatgcttagctgtgcatacctatatgtttccacactgtcttaaagaaaacaactactaaaaatttttgaagcaaatgaagaatctgcaagttgcaaagtacttagagacgttagagttctgaacaacaatagtgaagagatctccctgaaaaccctgggtattcaactgagaacccagaaagaaagcacattagaagtagggctagtctagacaccttctaatcacctttcaattacactgtaaggtatcaagttcatctgtctgtaaattaactgtctactaggacaaagtgtacatttttaaaggggaaattacaattgataaagactatcaacaatgtagcatttataatgtcaatcatatgatcaatactatatatgtagaaaagtggaaaatataacctactcaccttcctcaaaaatatccagtaaaagctgacctacaaaggatagtaatattggaattagcagacacatgttttacaagttattagaaatgataaatgttggaagtgatggatatcttaaatacactgatttgattattgcaccttgtatacaggtatcaaaatatcacatgtactccaaaatatgtatgattattatgtatcaataaaaaattaaaaatcaaggtaaaagttaagtacagtgaagtgaagaaatctcacatgtgcagttaaatgagttttggcaaatgcatatatcccgtaattcacacctcatcatgatataaaacatccctattatcccagaaagtttctttgtcctctttttcaatcagtctcagttcccagaggcaactactattctgaggtctattataaattagtttcgcatgtttttaaactgcatataaatgcatttatacaataacaaagttattagaaataaatctaacaacttagaatagctccaataaataaacaggtggaaattttagtggagaaataaactttaaaatgaaactaaaatttcaggaactgaaaaatacaatgtttgaaatgaaaacattgaatagacaattcagaaataaatacatgtgtttatagtgaactgattttcaacaaatgcatcagaacagatattagggaaaggacagcctctttagtaaatattgctggaaaactggatgtcaatgtgcagaaaaatgaaactagatgtgtatctctcaccatatacaaaattcaactcaaaatgaattaaaaactgaaccgtaatttccaaagctataaaactactagaagaaaacagagaaaatgcttaaggacattggtctaggcaaagattttatggctaagacttcaaaagcacagacaacaaaaagaaatgtaaattggtactgctattatggaaaacagtatggaggtttctcaaaaaactaaaactataattaacatatgttactagcaattctactactgggcatttatccgaaacaaaggaaattagtatatgaaatacacacctgcatctgatgtttactgcagctgtgctcataatagtagggatgtagaatcaacctaaatgttcatcaataaatgaatggatttttaaaaaagcatacatatatactttttaaaaagtatatatgtatgcttttttaaaaagtgtgtgtgtgtgtatatatatacataaaacattccattgtacatatacaatggaatactattcagccataaaaaagaatgaaattctgtcattcatggcaacatggataagtctggaggacgttatgttaactgagataagcgagtcaacacaaagataaatatcacatgctcttacgtctatctgggggataaaagaaattgcacttatagaagtagagagtagcattgtgcttataagagtctgaaaagcttgggaggaaaggatagagagaagttagttaacagatacattacagctagataagaggattaagttctagtgttctgaagcactgaaggttgaatgtggttaataatgatttagtgtttattttcaaatagctagaaaagagaatgttgaatgtttaaagcacataaaaaatgataaatgtttgaggtagtggatatattaattatcctgactttgtcattacacattttttacatgtatcaaaatagcactctgtatttataaatatatacagtaattacatgtcaactaaaaataaaaggaaaatacatcaccaaagtgaatgtatgaagaggaagaatatttgaataattttacatcaattaaagataaaaataaagaatgaattaaagataaatttatttagtaaattacataaatttaattcataattagaaaccttgccacaaggagaactctagaagcgggtggattgcatgatggattctatcaattattaaggaataaatcctgtaattccttgtcttggtttgttttgtgctgccataacaacctaccacaggctgggtagtttataatgaacagaaacttattgactcacagttttggaggctgggaaattcaagatcgagaggttggcatctggtgagggacttcttgctgcatcatcccatgacagaagggcaaagagagggtgagagagagagaaacaaaaggaggctgaactcgtccttttataaggagcccactcctgtgataacaaacctactcccataataaagacattaatccattaatgatggcagaaccctcatggcctaaatactccgtaagattttacctcttaatactgttgcaatcacacaatcacaattaaattttaacatgattccggagtggggagcaaatattcaaacactgtatcattctttctaaggagtatatgataacatccctgtactccttagaaagtgaagaagaaagagaacatttcaactaatattataagagtagaataatactgataccacaactagacaagaaaaatacaagagacaacattttagactgatctctctcattaacacgtgtaatagtctgttttcatgctgctgataaagacataccgagactgggcaatttccaaaaaaaaataataataataaggtttattagacttacagttctgcatgtctggggaggcctcacaatcatggcagaaggcagagaggaagaagtcacatcttatgtgggtggcaggaggcaaagagcttgtgcagggaaactcccactgtaaatccatcaaatctcatgagactcattcactatcatgagaacagcaaaggaaagattcgcccccgtaattcaatcaccttccaccgggcttctcccacagccatgggaattgtgagagttacaattcaagatgtgatttgggtgggacacagccaaatcatatcagcacaaatatgagaaagtccttaaacatatcaatactcaactccagcaatataaatagaggatagtgcattgagatcaaatgaggttaatcccaggaacttaagattggtttaatattgaaaaccaatcaatataatatattaagaaaaaaagaagaattaaatatcttggtagatgaagaaaaagcaattgacaatattcaaaaccaattcacgataactttcaatataaatgaataacaagaaacatccccaatctattaaaagatactcataaagtacccccttactgaatgtgcaaacactcaccttattcatgttaagattagcagtgagataagggtatccattctcagtactatcaagcaaactttaccagaggccccactcagagtaatttagcaaggaatcagtatagtgttaggaaaggaagaagtaaatctgtatttatagataacataactgtatacattaacaaaaaagcctacaaaaaaccctagaatacaaaatcacaatttgtaaggatgcaaatggggtaaaatataaacaagtggcaagtaagtccagagggcattcaggtttctcaaaccagtcttctaacttttgtctataagtttgtacttgtttcaaaataaagaatgaagaaacaacaaaacataatttctaaatgttagtgatattaagaaaaaaaatcagttaaaataccactaaaacccttaaaactttaaatacacaattataaacttaacaaatattgtgaaataccccaatactgaatactacaacattgctaaaaggcatttgaaagacctaaataaatggaagctattccatgtttttaaatagaaaaaattaatattgttaagatattaattctacccaaatttaaccataattttaatataataccaattaaagtcccttctgattttttttgtagaaacagacaagctgtttttaaaattaatatggaaacaaaaaatacctgaacaagtcaaagtaatcctgtaaaagaataaaattgaaggagttagccctacctgatttcaagaataaataaaaagctacaaaaacctggagatgctagtggaggcataaggaccacaaataggtcaactaaattgaatggtttgcagagaacagacccacatttatatgattgattgattttctacacaggtgctaaagcagttcaatggagaaaaatggtgctgaaaaaattggcatcccgattggataaaaaaaattgatgtttgacaactcatatcatattctaaaatcaatttgggataaatcatagccctaaatttaagagctaatactgtcagtgttctaggggaaaatatgaaataaaaccttactatactgaataagccaaaaaatcattaattatgaaacaataaattggacatcaataaaattagaaacttctcatcaaagacaccattagggaaaaggatatgcaaactacagtctggaagaaaatattttgccaaatgggtatcagacaaaaacacatataaagaaattctataactcaataataaaaacacaacctcataaaaacatcaaaacatgtgaacagttacttataaggaaaagaatgaacatatgaaaaagtactcaacatttggtcaggtatggtggctcatccttgtaattttagttatttgggaggctgacatgagaggatcttttgagccaagagttcaagaccagcctggacaacaaaatgagatcccatttctatataaaaaaaaaaaaataaaagcactcaacttcattagacattagcaaaatatagattaaaattataatggtatattatacataattagaatgactacactaaaataacaaaaaactgacaacattaactgttaaagaggacgtgaaaaacaaaaattctcgttctttgcaagtgggaatgtaaaatgatatgattacattaaaataatattttagttccaaatgaagttaaacatatgtaaacacaatttttttgtttatatataaataagaagacatatatacacacacacatatatatacacatatacattcatatataaaaacacattataggctgggcacggtggctcatgcctgtaatcccaacactttgggaggcggaggcgggcagatcacctgaggtcaggagttcgagaccagcctgactaacatggagaaaccccgtccctactaaaaatacaaaattaaccgggcatgttggcgcatgcctgtaatcccagctactccagaggctgaggcagagaattgcttgaacctgggaagtggaggttgctgtgagccaagatcattccatttcactccagtctgggcaacaagagtgaaactccgtcacaaaaaaaaaatacaaaaaacaaacaaaaaaaaacccatacattataattccattacaaagtatttgcacaagaaatgaaaacatgtgttcaccaaaggatttgtaagaaatagtctgtagagaagctttatttacaatagctaaaaagtagagactatttaattgtccactaacaggaaatagactttaaagtaagacttatctacacaatggaattctacttggccatagaaacaaaatactgatacgctcaacaatatgagcgaatctcaaaaacaagtggtgtggaagaaacctcacactacagagtacataataggtatgtaatgcatgatttcaattatctgattttctaacacaggcatatgctgtctatggggaaaaagatcagaagtgattgccttttgagaacctctggggaggagcatgagttaatgttttggggaaaaataaagatcctataacttgatgggataaacttgtcaaactcatcacattatacacttaaaatctgtgcatttcactatatgtgaaaaatttaaaacatattatttaaatggtctgtgaaggagagccctcaagaggcagacatttctctttgagtagaatgatgagcatagtcgtggaaatgagatagttaaatcaaccacttgatgctcttctcattaagcttgtattactagaaaattcatctctttcttttggctagattatagattgactagaatttctccacgtatttgttaaagtgttctggatggtttttattcggctgattagtaagtcatttaaaaattggcctacaggccggctgtggtggctcatgcttgtaatcccagcactttgggaggccagtgtgggcagatcacctgaggccaggagtttgagaccagcctggccaacatggtgaaaccctgtctctactaaaactacaaaaattagccgggcatggtggcacacgcctgtaataccagctactcaggatgctgaggcaggagaattgcttgaacttgggaggcagaggtttcagtgagccgagatcgggccactgcactccagcctgggcaacaaagcaagactttgtctcaaaaaaaaaaaaaaaaaaaaaggcacaggccaggcataggtagctcacacctgttattccaacactttgggaggccaagtggggagaatggcttgaggctgagttcaagacctacctgggcaacataatgagacaccatcttatttttacataaaaaattaaagtaaaaatttaaaaattagcctacatatattgtagttagagaaagcccttctagacaaagatactgtaaatatttcattgcatacagataactgcaaagataaattaaaatgctttaatagaaaatagatccagtaatcctatcatactattgatctgacaccttattgatattgtattttattctacgtatggagataaaaagactttgcattctgttaattgaaataatgagacaaacaataacaaatgaagttttgagctctcaggggttctaccaaaacttggtggtactaacaagcagtggcattggtatctattttatttctgtgctttacagatatcaagaatggttaatgctagggtgtaaatggagaataaagaaatgattcagttagattttttttgatatcttcacgtaatgaagatctattgaaaaaaaaagtgccctgaaaagagaaagtgaccaattataatgtaatcataatatggatttagaaaaagaaattagtatttaaaaacatataaataatttattattaacaatttgagatgggtacctctgcatataggaaagcccctaatatgttgttacttatctttcttaatttgaatacgtttattatagaatcatttctttcagaaaactgcaagatatttcatgtcattacatgtaaacggtattattaaagcttgttttttctacacatatttaacgaggttaaattagtctaattttgctttttgcaatatgattttggctctgatctactgcaagactgttttgaagggacacataattttgtcatttcaaatgtttgatattttttctcaaagactgagttactactgataagaaaaaaagaaggccatgattatgagtgaattgaatattgaaagaatgtccactttttagttttattcctggctgtttgcccagttgctttgaaggacttaataattttgtctcccaatgatgcctagaggtgaaaagagacagtgtctggtggttcaaaacagttgaatgaggtaatcaaacagagctggaaaatgatcttctctccctggtgaggtactgctgggaattctgaaagaattcaccaaagaaaagactttataattaaattatcgtttagtccctattctctacttactcattcagattaaatcaataatgacaatgaaatctctcatggtgtttcaccagttgaagagagggaaaaaaaactgataaccgtgttttaaaaaagttaaatttatatatgctcattttggtctttagatgcttcatggagttaattgttttgtttcagaaatatgagatgacatcagatacgtggctctctcagcaggtacagtataggtggtctgtcacatcttggccattgtgaccatcctgttcacccattttttatgtgataactttctgtaaaaagtatgagtttaaggctttgctaggtttgacagagtgatcctttttcattaaaaggatcacttatgacttgggctttctatggtatcatttgtgaaaaggttacttccatttttttaggagacataaattgcagagtagctgccaggatcactttttaaaatattctgtgtaagtacactcttgtgtagatgaaggagaaaaactcaggacctaaccaaactagaaatcattagcattgttcaaattgtctgaaaaattgacctgacctttacataaattgatcatggagatattcaaataaatacttctcttcttagttgtattctagctcacaattctagtttgtgacataaatgaggctggaatcaagatgaacatgacggactaaaaacctaatcactgttacatggtctcatcctggacaattcagaaggaaacaacacaaatagcttatttaaatatagctgaattcattttactcttaactacattagtgagttttgcaaagggaaataagatgtgtggtatggtttggtttggttttctttttgttctttaaagccctcttttattttatattacgtctatggcgttaatgaccacccatattttgagaccttcacatttatccagacacttcagtgagttctgaaatatccaaatttatgcttgccatctcctcctaaatctgtaaaagtagcttcatactccccaggtctaagctgaactcattccttttctagtcagtcttcttaatttttatcttaggactcaatgacataattatccattcagatgttaaaactatttacctaatagtcatccttgaatcttttctcatttttatctatctatatataattaatatgtacagattttactttcaaacatctctcaagtcaatttacttttctctaattcacaaacactgtccatgttcgaactacagatccagcaagtctcaacccctcaggcacctgccaatctgttcacactgcaggctaactgagtgacctttttaaaatatgcatttaattgttgctactaacattcccctcatacttgcacttccacaactcaaagaacttttctctcttctttctgtccttcagataaagaccaacatccttaaaaggtccacaagggattaattgaaagctttttcagctctgagtcatagaatcatttgatctgttttctccagtctagctacatggaccctcatatgcacagggacttcataagtgcccttccttctgaacaaaattccctcaaactttcttatatgaagcctatttatttttcaaaccttggcttaaatcacctatgtaagaagtcacttcctctaactagcctaaccaaatcacatctcccaataaaagttatattaaagtcaagtgtaatctttgtgtaacacacaattattgctatgatttttttttttgctaagatacaaggacatgaggatgttttttacttctaattgtaaaccaaacgcctagtatagaattcaatatgtaagaattcaatatgtaagaagagcttaatagatacttactgagtgattaagaagaaaagtaaaaaggattataaataattgtttgtctgaagggtaggtagatggatagacacagataaatgtttgtatatatattacgagtatatgtgtctttgcacatggttatctattaatataaatacttttatcttggtcaatgtacaaaataaaatagaaaaaaaaccctgattttacagctaataatagactcacaaatttcggttagatacagaaaataagaacaatggacaatatataacacataatacttatgcattctgaatttccctccattattaaacatcttttgctattactttgattgccagtgacattcataatagtttaacatatgtcaacataatgcatgttcttttgagattatgctatctaatttttaaatcccaaatttatgaatgtttaatagaaacttttttaaaaaacaaagcatccagttattaattattcagttagtaaatgccattggtcgtttatcacagttgatttttttcttcagatgctctaagggaattttatgaaatacttagagttatatgaaatttaatgtatgagcatggtagcagtaataagaagcagcaaatttctaagataattataaatttaatagaatcatcatatactgtctttttgcatagcagaaaaggcaaagagaagtaggcatgtttagcctagctttcaaaggacttgcaattgagatgaccagtgtgtaatatatttggtcaagggaatagagtccaatatccccagcttaccatcttgtgtgtcaaaaacactgacttgtataatgtcatgaaactgagcagtgagattggcaccatctgtgtggagctgaatgtttatcaccagacattgtcaagtgttgggggcagattttttagtccagcaaggcatatgagattgtagcccccatctattccttttctgaactacttctaaggtactagaactggggaggaggcaatgtaaatggaagaatgcttatatatctgtatatgagaaaaaagctattcatcttttgatagaagtacaaagggagaacggtaagggaggagttgctatgtgggggtaaatctggtggatagagtgatatataaaactaatatttttgttcatggtatccatatattcatctattcaccaattatgagttgggacctactgtgtcttaggcaatagagctaaacagataacatttaaaatttagttcaattattaattgcctagtgaaggaagccaacaagttaatagatcaatataatagagtgcattggaagccatgataaagatgaaaacaagatagtttttagaatatctgaggagagatttcctaactagggaaatcttggaaattcttttgtttcatgagaataagtaaaaaatgagtaagatttagcagaaaaaggaagacgaaaaagttgttccagacaaaagaaactccaagagagaaatatcccacaggagcaggtgatggaacaaatagaattattgactttattatagttgaaagaagtgattcactcagtcaagtattttgtcagtatccattatatgctcagttatacaatttttccaaccttgaatggtatattatctcagagttttaaatttattacatatgttacttatattttcatgaatgttcataaggcagttaaggaaaatatccttattttactgtcaagagatgtattgtgaatgaagctaaaatcaaactgttcagtatattaaaatagttattaattgactgattcattcagtaaataattattgagctcaatttacatgatagtcactgtttcaggtgctgcagatgcagtagtgaaaaatacaagtttcctgccctatggggcttacattacagagaactacatacatacatacatacataagtatgtaaatatgagattagtgcaaaagtaattgaggtttttgccattacacggtaggtcgcaactcataattgatgaatagatgaatgtatggatacaatgaacaaaaatactcattatatatatgtgtgtgtgtgtgtgtgtgtgtgtatatatatatatatgtatatatatatgtatatatatatatatatcactctatccaccagatttacccccaccattaaaagtaatggaaaaaacctcaattaattttgcaccaatctcatacatacatttatatacagtatgtacatatgtacatacattcatatacatattttgccattaagagtaatggtaaaaaccacaattacttttgcaccagtctcatacatacatacattcatatacaaacaaacgcatacatacacaaattatacgttgaatggtgttagttgctgtattagtccattcttgtactgctataagagaccaggtaatgtatgaagaaaagaagtctaattggctcacagtactgcaggctgtacagaagcatagtagttattgcttctagggaggcctcagaaagcttccagtcatggcggaaggcaaatggggagcaacacttcacgtggcctgagaagaagcaagaaagggatgggggaggtgttatacacttttaaacaaccaggtcttgtaataactcattcactcactgtcatgagacagcacccagcggttactgctaaaccattcgtgaaggactcacccccgtgatccagtcacctcccaccaggccccagctccaacactggggatttcaatacgacatgagatttgggtggtacacagatccaaactatatcaggtgctatggaaaactagaaagaaaataaaaggagatgaaggatgtcagatagagttggatggtctgactttcctgatctcgctttatatagggtaataaggaaacaccttattgataaggagatttcggattagagacctgaaagagataagaggaagatccagaccaagggaatacaaagtacaagagccctggagcaggatcatgcaggaacccagtgaagaaagcaagagaatgacaaagatgagatcagaaagacagtagagggccaagtcatctaaaagggcttgaaggccattgtgcagagctactcaggacccatatcaaagcctttctttataccatatataaccacctctcgttagtccagcaggaaaaactcaatgtttcatcagataaatgtgttttcttaatgtttttcctgaagaaagagcagtatctctctctctctacatacatatatgtgtgtgtgtgtgtgtatatatatatacacatagtgtgtgtgtatatatatacataaatatatatagtgtgtgtatatatacacacacataaatatatagtgtgtgtgtgtatatatatatgtggctttcatcatttaattttcaaaaataattctattgatttaatgtgccaccagagtgtaattaaaaattatcaaatggggtcacagttgtaggtgggcatttgtgtttgtgtgtttgtggagagatgagcaataaggatggtaaatttgaattaaataactttctatagaatcctttcaatttcgtggcctgtcgtcttttgtattttcagttaatttatgaatacattatcagaaaagaatcttcaagtaagtacagttgctgaagaaaggatttcaaaaaatatgttacagaattttgtaattaaaagatttattttgataaactgatgcagatgtttgcatgttctttatctttgaaggatatttcactaaacacaatcttatgtgaagatatgacagttcttgtttgaaccaatttaaaaagtgtctttagtctgataataaatcattcatatccaccatgcacaaatttctcctatccttcccacaactcaaccacatacatatgtaatgtatcagatttactttaaaaaagtttaaaaaatagcatacattcatttttttaaaataatgtgcccattttcctaactaattataaatcaatatttggtataacccatgcaggaattaacagtagtaggcagcacagattgcatgtgcctttctgagattgttctgtgctcttctgtattttagaatgaggagcccgtgttttctagagacggcagcaaattctttatgacagtgcctgttaagcaagggggacgtggagaatttcaccacgtagctatgttcctcatccaggtaagtgctggcttttttccatgttttgatttcattgtcctcatgtccccgaaggcccagttcttgtggcattctaaacctctagttcatggtggtgaaacccagccatatatacaactcacagacatcttaggaagaggacctccatccatagccatacattcaagccttaccttcccacaaaacagtctcaacactcagtacaatttaatgagttacatgtgtgtcctatgaactgagggctttgggatagagaatttaataaattaaaagcacccaacttttgaggacctgagataatctagagaagattttttattcaatgaacatatatataacctattttgtacaagtaatattctccaggtgttataaaagttttaaatactcaaaggaacctaaatgtccatcaaaaattgatggttgaataaattatggcacatccccacaagcaaatacagtgcagatttttaaaaaacaggataaaatagatgttttatgttaaataacatagatttcatgttgtaaaatataatctatgttttttttttagactttccgataaaaagaggggaaaggttactttttatctaatcaaaagaatatgaagggtttatacagttttattataaaaaaattagtaaattcaggtagttagtttaaatttgacaaggttattgagtcaatctgaatttaatttccaagagcaagcatacatgagaaaataaagcatccttcaaaatcatataataaataatctagtctcacacacaggttaaaggctttctaatgaaaagtcactgtggctaaactgggatcttcatgagtgttttacaaactagctaagagtaatttcatacttacaaaatatagaataaatataaatatggcaaagatacctaactgaccttactaattttatgtttttagaacctttaagacctgtgcacattctcaaatgattaccattatccatatacatttgtattggacagcttaatgctttagagtctcaaaatcttatgtcactaatttaaaatttaaaacttgttcagggtctgtgtaattaaaatagttgtcattgttttaactttaattttaattacgactgaaagaaataatttggaatacatacaatttccacagtacagatgtagattgattttcatagtatattattaaggtggaaaaacaggttataaactaatgtataatgtgatcctatttatgctctaaataaatgcatttatagatgcatttatatatgcatttatagatgaataaaattttggatgtttttatatctagctattaaaatgattatataagtcaggtataattaagggaactttttttatgaaactgaaaggaaatagactagcaaattactttactttataaacttttgctaattaagagtcaacttggttatcacaaatattagagaactattttggcccctaaaatatcacacttcccaaatcttataactgattatgacatttcattgaatttttaaatttcagtattttatattctagaagctctgtgaaaaatataagtagtaaagaagattacctacaaattatagatatttgtaagagatagtgaaggataggaaaagttgtacgtctttgtgtatgtaattccccaaagaagacaatctatccttgactgtaggtaccctgctgtgctttcaaatgctagatcttacccattctatctacctatatttttgtatccattattcaacaaataaataatagaaataatgtctttgtaaaagtatggcgttgggtagggttgtgatgttgacatgcaggaattaaaatatttatacacccaaaccaagaatttttttataagcctagggaagaaataccttctgtttctcagtcaaaccagcctaatatgtaggcaaattcctgtatttctgaaatgttcagaagaaaaacttaataaagttcttacattgtgtttactttgttcctcttctatatagggactataacacagccttcattgaagtagaaaacattttttttctattctggttgctgtttaggtaatttgtggtttgcctcattgagaaatgaacatgactgcatgattatttatgaatattttggcaattgattaaaattagtctactttgctaatgagtcagaagtcagtgctaggtaaatacaatttatacataactttgaacacacacaaacacaatcacatatgttattttaggaaatggtttgaatcaccttgcctcaatttaaaaatagctaacaaaaaagctatttatgaattgtgtatgactgcttaattgacatatatgcactataaaattctgaaaaattcaaacttaataaactgataaaggagtatataaaaatcacccacaatatcatcacctcatattctcacacttttaatccattattgtgtatattttacattcttttttcatgagaaatatatgattttcccctaaagattgcaattaaagcataatatagatttgtaacattaaaagaataactaatgagtgttttcttacaacatttaattgtattcctaatatttaacattttatatttttcttaaatgtgattttaatagctgctcagcattacagcaagcagatatactgtactgtatttatttatttatttatttatttatttattttttgagacagagtctcagtttgttgcccaggctagaatgcagtgacacgatctcggctcactgcaaccccctcctcccaggttcaagccattctcctgcctcagcctcccgagtagctgggattacaggcacccgccatcatgcctggctaatttttgtatttttagtagaggcgggtttcaccgtgttgcccaggctggtctcgaacttctgacatcaggtgatccacctgcttcagcctcccaaactgctgggattacaggcataagccaccacgcccggcctgtactgtatttaaatgatccaagtttattcatcattaaagttatttctatattttgatgttagaaatgattcagagttaaaagcccttataaacactttacttataattcttcccgcaaaattatatttctagatgttaaaagatacccaggcagggtatatccatacgaatgtatttgtttaggttttgatgtgtaatgccaaattggctctccaaaaaatagtacaaaaatttactgcctaaacagtaatgcatgccagcattgatgactttttaccccctttccttcccttgctgtgctacatgattctacttaaagttgtcgtgcctgaaaagtgagaaatgacaggactggggccttggcagccaacagtcagccaggtcacctttgcagtacttggcgcttacctatgtttgagagcttactagttcactcagaatatatttatttgcttgaagtaccttactaaatgaaattactaaatttttgcaaacattttgctctctcatattatcagtaagtagataaaaatcattaattagagaccaagctagacaattattgatttcaagctattttcattatggagagtgatggcggtcactacatatattttagtgggtttttttttttcctcatttacaagagctgtccttgttaaagtgattccaaaggatacaaataaaaagagaaaagaatgcatgtgttttcctccagtcttcatttaaacattattgtaattttatgtaaactacagtattgcatcctgatatgtcaaatttaaattttaaatgcacacttttcccacaatgctaaataattttgaaaaataattctttagaagattaatattgagttgactggatgtgcatcaataaccattatttgttgttctgtgtttaatttagtggcaatttgttgtaatgatagatgtcactgtatataaagcttatttatattgtggattatttctttagtattgattaacaaaactggaatagctggaccaaaagtaaaagatttctaagccctaatatatgtatttccagatcactttcagtatgaatatatgaaagcaaaatttgtgagtgttttctccactttcatatattccattaaagaaaatattaaataaaactatggcttttctggaaatctatatagctaaagaaactgttcttctggatagagtgttttgtacacgtattactatcagtttatgtacttcctgagtcatacactgatacaaaaccttttaccccagaccattaaacttttgatcacttcagatattcgcccctttgccccttgaaaaatatttgttatgttgacttcaaacttctgaattctcatctcaggaactgtaacattctacatcctgcaattcaggctgcagtgaagagataggtttttatcaaaggtatagcacctttttctctcaaagatggagtaagcagaattttcattgtgttcagtcgttcagattcataggcgtaaggaatggccctgtcaccttctaaaattgtgttaaatgaaaaattatatgtgggtgaatccattcactttctctattcagcaacacgaagttttgcccatgagagctgatgatttcacttggaacgattttaagtggcattattcactacaaatactgtggaaaacagcatgcccccaatccacaattttatcacctaatcaacccagtaaaatttttgcattaagtttcactgctgcatctgattaggacattgtctgaaaacaatgagctcatctcatgtggtgaatagatggcaaattaaagcatgctatttttaagcactacaatatttcccttatttagaaactataaaagtgaacatttaatataagaaatgtgaatgaataatgtgtaattaggtaaaaagaacatgcagggttaaacttgtattgatacccaatgtgtttccaatttgtaaatcgcattataaaaccaatatttaacttccttgagcaagataaaatctctatgaattgaaggtcacttgtctggtgtctaatgctccaaataaacactctattccaaatttccagccctcttttaagaatgaatgagctcacgacttttgttgctttttagtctgaaattaaagttgaaatattagttcaatttaaaatacattgtcatactgcctttatcaaaagtctactacagttttatatttatattcagtatttctattctaccaagttaatattgcagagattatggattcacagaaacaaagaaatgttattgtagagaaaaaatgctgttctttcctgctttgttaagtgatctttcctgtgattgcatttctgctgaaggtgcttaaaaacctaactgaagtacaaacatccccttgtgaaatctgctcaaatactgtgatatttattaagtgttgttcagtcatctaccatattctgattggtattaagattattagccaggtcaaaattaatgtgctcactgctgtgacagtcttatgtagattattagaaagtaaatctttgctattatatgcaaaatgagggttcaacttgttccccataccatatttgccctggtagattaaaagcaagcaaggcaattacagctgtttcaaataaaatcaaaaggttatatggttgttattaaggcttccaacaagagatcttttggtcctacacttgaaagtgtaatattttgaactaaaaggatcattgaagtaaatcatatataatattttttatactgtgttcaaacatttttcaaagcattgggtttttactcatggcaattttaatgttgtatctcatttgtctttaaaacacacatacacacacacacacacacacacacacacacaccaaaatactctgaaaaacagagaaaataattaacctagaaatctgtgggccaaaagtgtctccagatgttttcaaatattgagcaaagtttcttcacttttttaatgttttgagattattttatcttgaaattggcatcaaagatgcactaaaaccttgaaattttagtatcctgtccttggctcattcaaagcagggcctggaaacaagaaagaggagctatccactgagttatttgcctgtgtgaacttggcaataaaatgtatgactttagaactctgtgccagcctttgggttatgcagttctcatatctcacaaattgggtgtctttgcacttatacctctagtcaacaaatacttgtaaatcagtagtacgtcagatagtatacaaagaagttgatataaagaagtcacaggcttgctgttgaccttaagcagctagacgtctagagaacttccactaagaacataaaatagactacttagggagatattgaaatgcaaatacataccaataagacagaaaatttttcaaaggaagattctgttagtacacatgtgcagtaaagtatggaatgcccttttagtttacactttcagttgtgtgggaaaatagatgttataataaaactatcctatatgaacctaattctgaatttatttttaccaaaaatgcattgaaagcattactcagctgacagattacactctctgaagacaatgaaattgaattgcacaaataacaacatttaaaaggttatacatttggaaacaaaatataatttctattcatagtttcaagaagaaatcagcaaacacttagaactaaatgagaatactacatatacgaaaatatgcaatacatataaacaacagtttttaatatatgcaataattttatatgcatatatgaaattatgtatatatccaatgtcagaatttagaaaaggaagagaataaattcaaatgtaaaagaaaggtaattagaaatgaaagaatagcacttattaatctagtaagcaaacatgaaataaagcagtatgataaaacaaatagtaagttatttggaaaaagtagttgaatctataagagctgtcaagggtaataataacttggacagttccaaagtataaataatggaaagggacaaaactacagattttaaaaatattaaaagaatactatgaataactttacattgataaacttgaagtttaggagaaatggatgcaatctagaaaaaaaaatcaaatcagatttaagaaacaatcaaaatcctccatagtgttaagaaaatggaatcagtgatgtaggattttccacatcagggaaaggttgtttttaaaagtgaatctcaccaaatattctaggagtacgcacttccaattttatattattttgaaaatgaaaaaatatggcatgtctttagtacaatttatgacatgggtatcatcttgtaaccaacacgaaattaaaacagtatcagaaaagacagtataagaaagcttaaaaatactaaaccaattattgacaagttgacttatttaatgcatttaaaaaattaactcttattttttgaacagaaatgcaaaatttacttaaaatttcaaaaatatgtaagataattaactgcatttaaattttcctgagaaaattataatcaccttaatagatgcagacataggatccaagtaaattcaacaaaatcagtattcaaaaaccttagaaatttaggaataaagggaacttctttaaggtgatgaaggcacttgccaaaagctttattcatatagcataattgataatggagcagtagtaatattccctttaaaatcagcactgagataaggaatcagagtgaagtagcttgagtatacacaacactagagataacagttgtttttgtttttagctgttgttgttttatacttgaagctctggggtacatgtgcagaaggtgcaggtgtgttacataggtatacacgtgccatggtggtttgctgcacccatcaacccgtcatctacattaggtatttctcctaatgctatccctcccctagcccccaacctcctgacaggcgccattgttcagctcccacttatgagtgagaacatgcagtgtttggttttctgttcttgtgttactttgctaagaatgatggtttccagcttcatccatgtccctgcaaaggacatgaactcatcctttttttacggctgcatagtagtccatggtgtatatgtgccacattttctttatccagtctatcattgatgggtatttgggttggttccaaatctttctaatccattctaatcagtgttctctaactacataaagtggttaaggaatagaatgatagtatttctaagaatactttttgggtcaaacaatatatattttttagacaatactactacctgttttttacatattaaaatgttggtcctataaacaccttggaagcattgattaagctaattaccttcatcaacatgaattcatctctgaaaaaaaattattgcattaaatggcaaatcttataacaatgcccatactgcaaaggttaaaatgaatacaaacctgagtatttattggagtaaagtttgttctaaaatgttttttttttttaaagctaactgtacagctgccagtcatttacatgagagtgattaaagtcctaccttggaagcaaatgctgccatcaacatggtatacttgattcaccctcacctggaggagttttctgaatgacttttctatagttgaaatgaaggcactaacctacctgccttgatctgtgtttataggaatgcatgttcattcttgagctgtggaacagaaaactgagtgttaactgagaattagagaattcgaagtgtcacaagcagttggtacattcgtgtttaccagagagatgctgtttaaatgaaaggaaaatcaatattttctatttctttgcagagtaaaagtgagcaaattaccgtgcggcatctgacatcaggaaactgggaagtgataaagatcttggcatacgatgaaactactcaaaaaatgtgagtgttttcagttctctagtcaggctgcaagttagcgttgtcaaatgccatcttttctaatagaattatgttttgcttaccatagtcctagtcaaaacaagccagccatggaaagaataacctttctttaaagacctcttccacacttcacacagagacatcttacacagagggatgtgtgtgtgcacacgcacacacacacacatatactcacacacagtgattgagagaggttatgaaaaaggatgattttatcaggggaaaaaaatatgtttcctagtttgatcatagccctgtgtttgtatagcaaaacaactcctgtctgtattttgacagttttaaaaattcaagtgaagatttaatgtgaaaattcaggtgaagattcaatgtgaattcaggattcaatgtgacaatgtgacaaaattcacagatcacaaaaaatagatctgtgtctaatgcttgtgttgttttctttcctggacagttactttctgagcactgaatcttctcccagaggaaggcagctgtacaggtaagcagtgtgcaaggatctccttacacagattggcttctcaatggctatctatgtagcataaggaaggaaaggaaaaatttgaaatgtctttttcaacatggctaggaagagccaactttgctgacaaagcttcacactcttgcaccagtctctcccttgacaggactggagaaaatggagccctgcttgctccttcctgctctgcagcctccttattcttttcttcacctgcttttgcagtttcttaatatcttttttgtggcttatttctctcaactctccacatcagagagatttacgtattttccctcgtgccttcatcttctgctaagtctcattttgaattttcagtgcattaatgtggcacaggtgaaatttattcttgtacaatataatgttgttgtgaacagttagtctagtgtatcaagcaggaagctttccctctttgtcttgttgttcataaaacccagtgagattgttgcaggaggaggcatccttatttaaataaggaacgctcattgcttgctaaaataaagcaatataggggaaaataattacatttgttcaatttcccaaatgcaaaactatactcaaaaaaaggcttaagctcacacctatttagtattaaaatgtctcctcactcagagagctttcaccaggatctcacaaaaatgacttttatttttggctggcaagcaacctattaattctagactttatatacatgttctaatttccatttcacagatccatttttaaagtgtcaaaactgccatgacatattctcaggggaaattcatcatgttttaagaagtgtcaccactaattcttaccgagtagtactgactttcctttgagagtaaaaatgcatgcttaaagtaccccgacttcctctgcatcacccccacactcttatttatacacaatttgctttcatcagaagcaaccttgtccttttaatcgcctttcttaatacatcattattataagtttattctcgtggacctcctggaacgcatgttcttaattctgacttccaggaagcaaagctattcatatagagatagtgatttgaattttggattcgggatcttgatcaaagtactggtcactttttcttttggtgacctaaagcttatctttcttgaaacatacattatgattgatatcggtagccataaactgtagcttagagagatagaaacactttatatcttataaaactctcattttataaaactcaaagaaaaatgacagcatcagaagattagacttggtcaagttcagcaaatggaactgcctcaatctttcttcccattattagtgtaaaatgtgatttgaatcataatgacttcttagatttgtgtgcttgtcttatctctctagtgactgaggcagaacagtcaatgtatctctgacatgtactagtgtagtcgacagtgttacaaagaaaatgtagtagcaataaattttcccttaaatagctcatcaaatgccagttggcttgactgtaagataatgttagtgtttgacccagaaaatgcaatcaatgtcttgcccaggctataaaaatgatcactggttgacttaatatatggcactaggcacccctgcaggagtaggactgctaccgtagtcattgttactttctttgtctcaaaatttgtgtctctttatttcagcaatctcataatctaaataatgagaaaataccacataaatctccagggagcttggatctaaaagctttatggaagagtagagagaaaaaggttttaaatcttagtatgtcactgaatagctgtatgcaactgggatactttctaagcttttctgtggtgaaaattgtacaatgttgtgaatgtaattaatgaaactgaattgtacacttagaaatgcttaaaatgacaaatgttatgttatacaggtttaacccaaattttataaaatgaaaaaaaatggctatggatattttataagttatcatgagtgaaactaatatgatttgtgcttggtatatattgttttgagtattataaggaaatttttggattgtaatcatctcacagtgtttcaaatatggaattgtgattttgtgaactgtttcttgtagctgccttaacacccctgttccaatccccatacctacagcgtattgcacatcaaaatcaacgtgaatattgttcatttgtaaatatacgaccaaaaatcatgtttcattccaaaatgaaattgagaccttttgtctgatcaagtttttctaaaggtattctcaacagtgttttcatccattgacctaccaaattttgcattcagacttatttattaaataaacaatttgataaatgaaatttaatcttatattaatttttcaactcctgtaaccttaagcaccactattgtaaaataaagatggtgatgactcttctttttaccacctcattatgtcaaagtgtgtattgttgttagtgttatatgtgttataatacaaatgtaacttttttaaaatcagtaatttttctgcaagtaaatgatggggaaaatttggcactgataccaaattctaatgtttagaatgtttaatttagaaaatcatgagctggatttttttgtttgacttgtggaaatgcatattccttctttcaattagtatgtattaaacattgaataatctctgtgggaaattccctttaagactttacacagaaatatctattaaaaatgcaaaaaacagtaagttaatttgagttccattgaaatcagttctttgtttatagccatacatacaagtgtacatattacatacataaaataatacataattttaattttaatagattaagaaaaatgtgtatgttttaacattactaatagaaggtgactttttatgtatatggtgattcatagtttacagtgaacctctatgcaagcaccgatgtaactcccttgtttatattatatttaaatatgaacaccacacattcaagtgcctagaatagtagcatttctataataacttcctttttctttctccagtgcttctactgaaggattattgaatcgccaatgcatttcatgtaatttcatgaaagaacaatgtacatattttgatgccagttttagtcccatgaatcaacatttcttattattctgtgaaggtaagataatacatgaattctgatataatatattttattcattgtatttggtcaatatctgttggtatcagcaactattactctagatgatttcataatcttaatttataaatttttgttaataggatatacattatatatagacttactgagatacaattttttacatattttgtatagaaataaaaaatgagaataagtcaataaacatgcacacataattaataagtgctatttgaacatgagcaactttaaaaggtgaataaatatatttacatcagcgaggccatgccacaatcataaactaatttacctagtcttcagaaaaagtaatagtctagtcttctttttaaaacaatgctttggttgttaagagatttaggatctatggaaatttaggacctgtggaaattgaattcccctgcttcagagttcttcagttctgatcaattacattcaccattattacttcttctatcttgtaacaatatgcgtagtcttacatgtttatacagtatctctacaatatattcatagaaatcattttccttttaatatggtactgtattttccagagattaaatagaactcatgtgtcctcttataatatgaagagttgagtgctactactgcagctgatatattaagctgtccttttttaagagacaatgagagatataccaagacttactttttgacattgtttttctcttgatatatgaaatgaagtaatcaaaaaagaagtccttgtttaatgacaccaggaaaaaaaaattagttttagatgggattccttagagaagtgaagtttcaagataactttttacagtaacaaattagctagtgtattttaaatatttgaagattatggttaacgtatttttaaattaatatatagttaccacccaattttaaacttttcttatggatgaactatttccaatatgcgtgctttctttttttggctgagtggcaaatagaatttgatcttggatcagtggatgaggggtgaaagggttgtgaatcagctttgtgaacatcagtggctagtctataaaagactagagataaagagaaagcatgtagaattggctaaaaacatagaaatatagaacatttgggggaagagagaatcttaacaataatctctgcaaatagtttccttctcatatattcttacccttctgaataaaacgcttataaataggaatgaaagctagttatctggtttctgttttgttatgttttaaccacgaagtgcttccatttggggggaaaaaactattatgtaaactttctaatgattattacttagacatctttaaaaatatttatacacatatttttaaattccaggtccaagggtcccagtggtcagcctacatagtacggacaacccagcaagtgagtacacaagaagacaattaagaatagttatggttggcattagtcttagacatcgtgttatctattctgagtcatatcctctataaattcttcttcaaaaaatccccaccatgaggaaagctgcgtgtataccatcaacttgaccttatgtatgtaagagaaacagtaaagcaagagatatgagccatgttacaggtgggaggtgaatcttatatgcccgaaataggatatctactacctaagtcaaatagagttattgatgaaacaggtacattttagcttactggcctcttaatgttctggttcattcttgcctgggcctcacataagttattcctccagaataaccttttgaagacatttcagaaaattatgaaaaatgtgttattttatatattttctatcctgtttgttccagatatccaggttcttctagttttgtatatgcactttttcatttatgaatttattcatttgtatatttgttaggtttgttaagagatcacctacttttgtcaaacaatgtgacagagtcggagggtacactgaaagagtgttttgttcaagaacttacagtaaagtagataaataaatgcatggttgagcttatcttaaaaatgaataaccagatttcatcctgccttcctttctctttcctttcttccatgtttgtatccttctttcattttttaagttttatttaatcaatgcttctattctgtgatgatttcacataagctactataatctaataatggctcatatttattgactcacttgaactttggaatacctctgagatagttaatttgattatccctttttacaggtgagaaaaattagtctcaaagaggttaagtggtaataacttggccagagtcatactaataaatggcagaaccagggatcaaatgagacagtctgactcgagaataggtttataattcactacaatataataactactttttctattgtgcttttgcctcatgcattgcatactcttatttaagtaggagtcagttaggtggcttgacttagaagatatataggtaaaaaagtgtaaggttgaatgacaaatatcattttgagaaaacagaccaagaccatttatattgttcaaataatgtcatatagacacttagtgcatgcccgaggcaacaagaaatttctaaatttgtgttgggtttttgtgtggctgaaagatggtttagcacacattttagtttctatttatttcattatttccgtcttcagtgtaaaccttaaaaagattatgttaagcaaatcaaatatattcaatattaactctaacggcaacaataatgaccatagacagtacggttgataaaatggaaagaaggttgaatctcatagatagaactatcagtgtataaaataagtctatcacatgctttttgtgggatccaagacagtgcgttaacatctcaaaacatcagtgtcctccgagacaaataaacaaatgtgtttgcagtgaagatgagtaacattcatgacatataggacacacttaatcaataactatttgtgttacactgtatatcttgcctttaacaaaggatgattaaaaattttccaatctgattttaatttaattttatcctgttgttacaaggcaatgtcttttctaataacttctgctgcaaattacaaaacatttctgtctaagggaaatcatgttattttcctgttcaaaagccaatcatgtttgtctcaaggtcaacaaaaacaaaaaaaggctgtgaatagtggtcaagtgcttaattttcttttcaaaagataattacttagggagataaaatttatagtcaatggcaagtaaatctttgggtcaatgaaagcaaatataccaatgagtaagtcataactcatttttgggccacatgaagtagaatagtgcatggagagaaaattttaaaaaagaaaaaggaaaatatttaacaagcatggaaaacctttaaacccactagttatcaaagaaacgcagaagaaactactgccatgtaatttttcctaacaaattaataacattaaaaatttacattactaataaagatagaatgtggtagaaatgttaattataacatattaaaaataatagtcaaaacttatttcttttgtttttttgagacagaatttcactcttgttgcccaggctggaatgcaatggtgtgatctcagctcaccgcaacctccacctcccaggttcaagcaattctcctgcctcagccccccgagtagctgggattacaggcatgcatcaccacgcccagctaattttgtatttttagtagagacggggtttctccagttggtcaggctggtctcgaactcacaacctcaggtgatctgccagccacagcctcccaaagtgctgagattacagccatgagccaccatgcctagcagaaacttaattcttttatatcattttttcatttttgtagtttacactgagaaaataattctaaatggagaatattatgacaaagctattgaaaatagaaaaagacattataaataacaaataatgggagtttgtaagtacattttaatggaatattactcagtgccctgggcatcttccatctgtttttccagaaccacttttaactctcaattcttctcttcgatgttctctggcctagaagtactttctatagatgacttaggttctgttgccccatggcttccaactggattcaaccaaaggaaatcttgtaggcaactggaaagagggagaaaactgctctgggttgtttattccaccagccgtgttcctatggagtcaccacaggttggctgtgacctttggctgaagggaatcttcacccttgaccttcaggcccagccactgttttcttgaagttttctcttttcactgtgtttctgccaggttttggtatcagaatcatgctgacctcatagaatgagttgggtaggaatcccttccccttgattttttggattagcttcagtaggattagtagcagctcttctttatacatttcatagaatttgaatatggatccatctggttccagcctttttctagttggtaggctttttattactcatttaatttcataaatcattatcggtctgttcagggtttcaatttctccctggtccactcttgaaagggtgtgtatgtccaggaatttatcaacttcttgtacgttttttagtttgtgggcatagcggcactcataatagtctctgaaggctttttgtatttccatggggtcagtggtaatgtcccctttgtcatttctgattgtgtttatttgacttttctctcttttttcttaggctatgtagcagtctattaattgtatttatactttcgaagaaccaacttttggtttttatgctttttcacgtattcatttcattcagttcagctctgatgtgggttttttttttttcttcctcctgtagctttgggattgatttgctcttgtttttctagtttctctgagtgaatattcaccattttttaagcatttaaaattaaatgcttaggatagcttctttggaaatacactaatgtttaaataatcagagtttctttccattttaaacatgtaaaaaacctcttagaacatctagtcttccagatatatataataggggaagatatttacttacaaaagaggtagtttgatgtgcctgaggttacacatagacagcgtagtccaatgggagaaacataaaattacatgcttataacagtctatgattatttctctagtaaaagtgcacacagttcaggacaagaggaagtcaatgagaagacattttcagaaaaacgaatgtgtgtatacaaacataagaacgcataaaagtgttcacatttgcaagataaacattgttcatcatagctggaacaaaacatttactaaaagagcaaaactatatgaggccagaggggcagactggaattggattataactcttatgttttctaagtagtttggattcaatcatatttgttcaatgataaacctttgacattttattttattttttttctggccatggagtaactggaaatagacctgattcccttgtttcctttaataataataaaaaaaaagagtaaagaaaactggacaaaatatacaaatcaactgtttccagacattcaacaatagccagcatgggtctctgatccctgaaagaaggaaacaagtacaattagtgttgtaagttctctggctttcttgttaatagaaatttctgaactccaatgcaataaggaataagctaatcataatacaatgatatctctgagttgaggagacagaaaatgatattcagaaagattgaggcttatggaatgttgaggaatggtatggaattttatggaattgaggcttatggaaagatgaaactggaaatgaagaagccacatggagaaagacatctgcatagggctggaagagggatcaccctgaatcagctgctgaaaatacctagctgagtatgcataggaagatgcttcatgagtgtgggcaatgccggagctcacagagtggtgggatttgctcaagttataatcagcacagtagtggaacatttagaagagatcccagaagtgtcctgccttttgtagtgctaaactagccatagagcaaaggtcattcaaatacacactaaaaagatttcttgaaaagtcttgaaatggtcaacctgcctgcaacatatgccagaacaaagtccaacaattgttagaagatcacaacaaaacccaggctttcaaaatgtaaatgtcacaatggttggtatctaataaaaaattactagctttgtgaagaaagtagaaaatattactcataaataggagaaagattagtgaatagaaacaaactcagaaatgacagagatgatggaaatcactggcaaatacagtaaattagctgttacaaatacataaagccatcaaggaaagaatgaatgtagagagaaaacaaagataatatatttttatgaaagaactttgtgaatttaaaataaaatatttgaaatataaacttcactggaaaatactaagaacagattagatgctgcagaagaaaagatcagtggacttgaaacaatatcagtggaaaatttcttgacacaaatagaaaaggaatgaagaaagtagaacctaaattaaccataggccagtatctacatctatcatatttgtaattagagtcagaatggggcaaggaaacttgcaaaaaatatttgatgcaataacggccaaaaattttctaaatctgatgaaaaagttaaaaaaagttcaacataacggaagcaggataaatgtcaataaaaccacactagcgcacatcattagcaaattatgcaaaaccaatgataaagaaaaacattttaaataatcagaaattaaaagacacattacatccacatattatgcacatagtaaaaacgaatgactacagacatctcatcagaaaaaagcaaactggaagacaatagaacaaaatgctgcaaatgctgacggaaaaccaaactgaactaaacaaaaattcttaatagaaaaacaaacctagaagatatttctcacttaaaaatgaagacaaaaagaaagtttcaataataaaagaagtgagaacgttctgtcatcaaacttgctcttctaaataacaaattgatcaataaaaactaaataattagaaaatattttgagctgaaggaagatgaaaacacatcagattccaatttacgtgtaactacagctgtgattagaaagaaatttatgactctaacttattatataaaaataaaaacacaacagatcccaatttaggggttactacagttgtgattagaaagaaatttatgattctaacttattgtataaaaagaaaaggtttaaaatcgataatctcctctttcaccttaaggaattagaaaaagaagagcaaattaaaacaaagttgaaagaaggagattgaaaaatgactaagaaggaaatgatattgaacatagactagcagtagagaaaatgtatgaaaccaaaagttgcttccctgacaagatcaataaagttggcaaaattctagtgagagacatgaagaaaaagagaaaaatgtaatgccattaataaaagagatgatgtttatacaaatgctatagatattagaatgacaatagtggaacattatacgtaattttttgccagtatattaggcatcttagatgaaatggaaaaattccttaaaatacacaaatcactaaacattcacacgagaagaaatacagtatataaatatgcaattaacattctcctcacaaaggaaactccagatgcagctagtttcactggtgcattttatgcaacttttaataagttaataccaagtttacacaaactctttttaaaaatataaggcaggccaggcgcggtggctcacgcctgtaatcccagcactttgggaggccgaggcgggtggagatcgtgaggtcaggagatcgagaccatcctggctaacacggtgaaaccctgtctctactaaaaatacaaaaaattagccgggtgtggtggcgggcgcctgtagtcccagctattcaggaggctgaggcaggagaatggcatgaacctgggaggcggagcttgcagtgagccgagatcacaccactgcactcgagcctgggcaaaagaatgagactccgtctcaaaaaaaaataaaaaataaaaaataaggcgagtattgaccagattccaaatccagacatatatattaagaggacaaaaaaaagatcaaattttctcatgaatttaggtgcaaaacaccttaactaaataatagcaagtcaaacctagcaattatagaaagtatgatagtttgttatggccatattgggtttacccaaagattctgtgtttgctataaccttcaacaaacaatgtaattcaccgtattacactgacacctcaaaggagtttttaaaaacttgaaaattttggcaaacaataataataataaattaataggaatacctaatcaagataagatagaaaagaaattcctgaacttcatgaatgatatctgtaaaaatactacagctgacatcatgcttaatggtgaaagaatgatgctcctgcctgaggactgggaaagtcaagaatatttgttctcactccttctgtgcaacattgtggtagaggacttagccagtaaagtgggtaagacaaagaaatatatgcagtaaaactgtgtttatctgcagaagacatactgtgtacaaaacaaaaaggaaggaaacaaaaaattgtggaatatacacacaataaactattgaaaataagtgaatttatcatggttacatctgtaggccaatacacaaaattcaaccatttcatcaatgaaaatgcaagatttaggagtatttttaaaatgctgtttaaagtaacatcaaaaatccatggagtatctaggaataaatccgataaaaatgaatacctcctctaaaatctgtataatactgctgggagaaattaaagactcagatttctacagacatagacttgtatatatctgtatacaatatgtacacatggatatatgtgtgtacaatatgtatatatgcaaacatatatgtgaatgtatatatatggattagaaggctatttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctagaaggctatttttgtgatgtaaagtctctccaaatagatctataaatttaatacagtgcacgtacctcaaaattccagcaagttactgatgtccacttcatgttttatcaaattttttgatgtttcatttttgctatttctctattactgtattttcaaggtcattactcttttgttcttcagtgcctaatattttattaatatcacccagtatatttttcatcttagatcatataattttcatgtatttcagattctgcagtttttatttttagaaatatataacatgctcatgctttttctaccttattaaatacctgaactacaatccaggtgtcctcatcctgtgtttctgtatcccttttaattggtataggtacctaggtattgtgaatcgcatctcatttggtgctagataatcttgtattttgctaaaatattcttaagcaggttaacaatatgatcagatttgcattttgaaaacgtaaatgataaatttaatatagaagcaaatgaaaaagttttactggcctaatgaagcttacttagaaaactgttgtagtaattcaaaagagaaatgatgagttaatcagcacagtgcctgccaaatggtaacaagtggataattttttgttgtgtcacactgattctgtttaatgcataggggttagctatttacactaccctttttggtttacagaatattttatattggaaagcaattctatgctgaaggaagctatcctgaagaagaagataggaaagccagaaattaaaatccttcatattgacgactatggtaaaattttgtgcatgctatgttattcaagaacaactttctctgcgtcttatagttttacctgcaaatgactctccatctttaatattttgctctttctttaaaagaacttcctttacagttgtcccttcccaaagattttatggaccgaaaccagtatgctcttctgttaataatgtaagtattttatttgtttttaaaataaaggaatctaaagattttatatttttgtgtctcacatgacaacatttgattcaataaagaagagaagtcctatgtgtgtagttaatcaggacagctgtctgttgtctaaattcctctagaagtccatcactaaatcatgtataaagatgtgtaaatttttttgaacttcttgcatcccacatggagtttggtgctactgccaggaatagtgacactaaatagtttgatttgtgggtgtctgcttagcaattactcaagccctgcgctctttatcagttgtttatgcaacattgtggaacatgtaattccactgctaaaacaatgggttatgtttgtatcactcctattgatttttcctcctgcatgcatggcctgcagtaagctgctcctatgctcagaaaacttgactcaagtttttttcatcttgaaattgactttgaagttaaatatctttatacattttgtaaggctatatcatgactatatagtattaggcaccgaggcccctaacatctaatgcgtaactaacttgatattgatttagcattgtattcctgagagttataagttatttcccttattaatatgatcaggtagcatattgatataatagtgcttaaaacagtctaaaattatatctttagatacaataatttcttcagatataatatttagaaatagtaaatatgaaaataacattgcttattatgatcactgagtatagtggataagtattcagtctgtggaatcggatttcctgggttcatattctagttttgctatttattagctgtgtgtccttgggcaagttccttaacctcctacaaggctaagtttctctaaatataaaacaatcattacaatacaacctgtgttttaagactgctttgtagactgagtgaaatacaacatataaagtcccttaaacagtgcctaacacatatgattcttataattattgcgattataattcttttttgtatagactgcatttattttatttagatattttaatatatacaagcaatttgtccctttattttaacaaaccacataatacagaaataatataatatttaattttctctctcactctagtgttcatttctaattctaattattgagctttatatagtttctcatatccaaacttttctcccttgtccctaaaagccagaaagctctgaaagttcttaatgtctccttgaggaagttcttatttgctgtttcttaattcattgtttttttttcttgtcttttttacctagtttcttctggtctattttaactgtatgtatgatttactgaggaaaaatgtttaaggcactaaaacgagacaaaaagaaagcaaaaatcaaacccatcttctatctcagtcacgtctccctttggtaaaaggaaatgttcttttgattcactgaaaaataaactttctcaaggaagggacatccctcaggcacatcctaggcatccctcagtatgtgatgaccttcaaaatggaagataaaagaactgactgcccttgaagcatgatatttatgcagacgaatgtgtagataattatgcccacttgcgtatccacctgctgtagggcagtgtcacacatagggggaaaaccgaataagagttaacagaatctctttgttttctgaaacagataagctaactggctcatcttggcatcagacttgtgttttgttctggttgatttttagtttataagaggaatataaggacctacacaagaaaccaatttgaagacttctcttattggcaaggggcacttggggttttttttgagaagtgggattttggagcaaaatgctggttttggagtcaggtaggactgggttcaagttggagtgctgagatttaacaatacactgctgaattttttgaatcttctgttgccttataaataaattggggaaaataacatgggataatatttctatttaaatatattaccatagtttttggtagagcataagcacttgcagatagtctttaataaatcataagcagaattataattattattagtatggtgcaaaagtaattgcagtcattataaatggcaaaattataagtaattgcattacttataaatgcaaaaactgcaattgcttttctgccaacctaatatggataatagtattttaaagtatttaatgtgattaatataaatatttaatgtgtaatttaatgcccataaagttattcaatagacagacactactaaaatagataaaatagtgccgtcagacccatggaatttactttgctacttttttggttgatacaggaagaatgaatgaaaatgagtataaaatcatttctagttatactttgttatatatagttatatattgtttatactaaatattaattgacattatccacacttttgggttttagagggaaattatcgaaagcgtcacagaatgtgacttacaaaatccaaaaggagaatttctttttttttaaatttatacttacaatatgatctattcttttaaattgcatgattatttctaaaacactatgcttgaaaacatataagggtcagaatagcaaaagtagaaagtgttttttaagaattttaaaaactgcccatgatttaaagccatattttttctcaagcttaaaaactgttttcagtgacaaattgacttcccattctaaaagtaataataattattatttttttcgcaaatgagcaattagacagtgataaacaatagagcgactattatttaaatgagtctaagaggtcattcagtgattttggtgtcagtactttattgcaattttgtgccatatatctggtagccaacagaatatgagccatttcttgatctgtagtgatgggtttacatccaaggaattatataatgaatgcatgagttagcgtcaggctgcagcaagcacctgagtggctgaaagaaagactgccctggaagaaagtggcctctggcaatttggaaacccagttctgctcaatcttcattatggatcttcaaaagaaatggtcctctgacctcccttgcttggtcatatgttttgaaactcaaacttaatctcgtaacatttaaaatgtaagtgaatcaaagatcaatgtcaatgtcacattaaaaagagtatgcgggatggagtacataccacattaatatttttactgtagaatatttttaccataatggaaaaatctaagaagcattggcaccatagatggatctcagtgacctgagtttgctgtggtctctacggagtcatgatcccctttttctgaacaactcctccaattctcccttcaagtgcctatttgttttactcctgcctttctgtttaacattatagggagcccttaaggacccggagtccttattcatttttaaacttattctatacacatctgtattcattccagctcttataacctcgtattgttcttttttaatattattcttacttcctactcatgtttatgtaatttaataccatacacgtctaccacattgcttttacatatgagaagccgtgttaatggctatggggagataacaagattgcaagcatcttgaagtctataatagttatttgggtttgttcagtctatctccgcaatgcctaatacacagaacttactgactatcctgtaattaccaaatagtgccaagactgaaggtgttgtggaaaatgccctgcacttgcagacgttcatttggtaaacaaacaaatatgaatctaatatacttagatgctgataaaagcaatccagaaggttgtactgttatttaaaaagaagggatttttgtttttgtttttattttctgtccctctgaagaggagcagcatcagctcaggagtttatttcagtaccaagggcccgtcatctcttcccattttctactttttcatgctcaagttatcttgccacactcgttaaaggtctaataagggaggcagtaaatgttcaacagattatattaacttccagaatgcaacatatgctatcttgcctccatgactttctttcctttctctgaattcaccttccttgaaatcccaagaaattcatggtcatccatcaagtcttatcttcctggagctttcttccattctcctcctctgtcagcctatggatcaggtcattctaaccggagagcattattcatttttatctagagtctcatcactgaatgttctgtgtatcagaatcctataattgggtcatcttggtagaagtgatctgttttctatataagtattctttcaaacagcatgatataagtaactgatcattcacaatgagggaatatattcagttattcatatccaacagtcaagataacatcattgctggtttgttatacacacatttcatttcctcaaacaacttgaaatattgtttaatattttaattagcatcaagcttcagacaagtcagacatcctatctggatgactgaactctaacctgctatactattctctacttacacttcctttctttagtttattgctttttgctctctctctcttttagttgcttttccactctgctgctaggttgaacttggcaaaatccatatctgagaatgtagccctcctatctaaaatcttctcattattcattcatcattgattaaagctctgcgttttccctcacactacgtaacagtcttcatgatatattttctatttttctcttcgtttttatctcacatcagccacccccaaagagaaatcccatcctttagacagactgctttgttctggggaacaccaccacttcaatcatcacttgtgttttcacatagcctcccagtgccctgagtttgcctgcccacctggagaagttctcttaagacttccagacacacttccagataactttatgcacaccgctattacaaacatgtaaccataccagattacaacatttactttgctttctctcctgttaaactgccaattccttttgaatagttttgccataccgcactaactggagcattatttgatagaataaatgaatgaatatatgaatacatcaatgaataagtaaacaaatcaattaaccctgagtttgtcctcaagaatgaattaagtcgagatggagaaatggagaaataaatgatttgtgagtttataattgatttctgtatgggtccatttctctgcaatttagttttgtactcagaatgagacgcgagtttctaatttctcttatagtctttctggatagggctgaatattgattgattttcatgctgtctcttcactgtttctttttacaatttttttacttagcttaagataataagaattgatattagctaccatttattgttattgtgcaaagagtgtcttgctgagaatatttagacatcatctttagtccttatagaaatcatccaaggtgaatactactgtcctcatgttaacacaaggaaactataactaaaataggtcatgtatgtgttcccccaagttcacagaaggaaaagttaaggtttggactcaagttttatatatctattttctgtattaaaacctctgctgtattacccaatgctgcctgcctacatagtccaccgtattatgataattattggcatattatcaaagaatgatgacttgaatcagaagaggcttctctactgccaaattcttatgaacttttcttctttccactgaacagtttataatagtttctggaatataacattttccacatgtactatgttaatgctttggtgtaaagtattgattatacaaatcatgactgagttcatgaatattccacaagagagatcaaattctcagctcagattatttaataaaattctgaattctcatcaaaatgttcactttgtgggaagtcttttctactctgtatttgtttcatagattcctagggttttcgcagatcagattgtgagaggtgagttcattttgtttcccaaggatgaagacatatatattccaataacttccaacatcatttgatcttctatttgttcatgccaaatacacatctacttttaccctcagtttcttgcaaaaatagtacatataccgtctgatgtgggtgaaagagatagcttgttgatattaatgtttgtctcaaagagggattattattgctttgccatataatgaggttcaaagcttaaattttaggtttatcatttttgtatctttgtcatttacatggatggagaatgtacccacactgtaatacatagaaaatgactaagaagaaaaaaggcagtggcatttaatcttgttaatagaaggggagaaggtgatcatttgtttctgtttttttcttgaacatatttaaacttgttctttcacaatttgtagataatgcatcttaaatgtcagcattaacttcttaccactatttaaagttgtacaaactcaaacttgctgtattaagaaggtgacatgggggaaaaacccaaatttagataaatttatagataatgcctaagctataatatttgtttggtgtttattttaactggaatatatatatatgtgtatatatgtgtgtgtgtgtatatatatatatacacacgtatatgcacacacagaaacacacatgccattttaggtcttctgttaacataggttttagatatgcatggattcacagaattatatgaatgatataatatggtttcatatgaatgatatgggcttattaatagttcctatttaaaacttacatgtatatgacatatttacagatacactactgaatactttttataagaaatattgaacttcgtaatttacaaagttcttagttttagatggtcatataaatgtagtcattaatgtaagggtaattcatattgaaatcagtctctttttctgttttaattagttatttgtttttaagaaaaaacatattaggatataagattaactatattattagtttaacatgactttgaaaggtgaagttaaaaataccaagatacagtgtattctttcttggtaatcccacacatctccacatcagaggaatacatcaatgacattatgttattccaggattttttaaataatatattctttccttttgacttatatataaaaacagtacattatgaatcatgtaaggctgtgtagcatgtaagtcaaagtgtgtctatgatgatgggaggctaggccagagctccaggcttttctagtccaacatacatatatttttgagcaacaagtaatgtgcaaagttccctactaaaaattacagggcttctaggagatataaaacttgggaagaaactaataattattgtatttttaaaagaaaaccacaacccaaataatacaattgttattaatatagtaaagttttaatcaacgttttgatttggaatcattcagtcattttcagcattggactttagcacttgttcttcctcttggagggcattctcttatagccgttttttctcatttttagcatgccattttaatcaaaattataaacctgatctagctgtagccttcttcattaatccactatctgagtccatgtctttgtagcctgtatgattagagctctcagttgtcacctgtccctcagtaacatggaggaagcataatcaattggaagttgctagatcagccacaactcaccctaaaaaagtgcttccgttgatttttagcttttttattaaggttccaatatattgctaagactttttccttacttataagaaaatgtggctctgatttcctctagacattaataccttgggaaaggctgtgtctgcgccactatgacagtgcattatactgacataatctccctgtttttcatcacatagaaaacatgtcatacaagataaatctatgttgcacaaaacatgctgcatctttgggaattaaaagtgttgaaaattatattgatacatatatgttaatgtataggttatatatattttaatttataagggcacacaaaaaaagtccatctatataacatgtagtttacacacttcctatgcttttattttttctttttttattaatattattatactttaagttttagggtgcatgtgcacaacatgcaggtttcttacatatgtatacatgtgccatgttggtgtgctgcacccattaacacgtcatttagcattaggtatatctcctaatgctatccctcccccctccccccaccccacaacaggccctggtgtgtgatgttccccttcctgtgtccatgtgttctcattgttcaattcccacctatgagtgagaacatgcggtgtttggttttttgtccttgcgatagtttgctgagaatgatggtttccagcttcatccatgtccctacaaaggacatgaactcaccattttttatggctgcatagtattccatggtgtatatgtgccacattttcttaatccagtctatcgttgttggacatttaggttggttccaagtcattgctattgtgaatagtgccgctatgaacatacgtgtgcatgtgtctttatagcagcatgatttataatcctttgggtatatacccagtaatgggatggctgggtcaaatggtatttctagttctagatccctgaggaatcgccacaccgacttccacaatggttgaactagtttacagtcccaccaacagtgtaaaagtgttcctatttctccacatcctctccagcacctgttgtttcctgactttttaatgatcgccattataactggtgtgagatggtatctcattgtggttttgatttgcattgctctgatggccagtgatgatgagcattttttcatgtgtcttttggctgcataaatgtctttttttgagaagtgtctgttcatgtccttcgcccactttttgatggggttgtttgtttttttcttgtaaatttgtttgagttcattgtagattctggatattagccctttgtcagatgagtaggttgcaaaaattttctcccattctgtaggttgcctgttcactctgacagtagtttcttttgctgtgcagaaactctttagtttaattagatcacatttgtcaattttggcttttgttgccattgcttttggtattttagacatgaagtccttgcccatgcctttgtcctgaatggtgttgcctaggttttcttctagggtttttatggttttaggtctaacgtttaagtctttaatccatcttgaattaatttttgtataaggtgtaagggagggatccagtttcagctttctacatatggctagccagttttcccagcatcatttgttaaatagggaatcctttccccattgcttgtttttgtcaggtttgtcaaagatcagatagttgtagatatacggcattatttctgaggctctgttctgttccattggtctatatctctgttttggtacgagtaccatgctgttttggttactgtagccttgtagtatagtttgaagtcaggtagcgtgatgcctccagctttgttcttttggcttaggattgacttggcaatgcgggctcttttttggttccatatgaactttaaagtagttttttccaattctgtgaagaaagtcattggtagcttgatgggaatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaaacaattgtgaatgggagttcactcatgatttggctctctgtttgtctgttattggtgtataggaaggcttgtgatttttgtacattgattttgtatgctgagactttgctgaagttgcttatcagcttaaggagattttggcctgagacgatggggttttctaaatatataatcatgtcatctgcaaacagggacaatttgacttcctcttttcctaattgaataccctttattcctttgtcgtgcctgattgccctggccagaacttccaacactatgttgaatgggagtggtgagagaacatacctgtcttgtgccagttttcaaagggaatacttccagtttttgcccattcagaatgatattggctgtgggtttgtcataaatagctcttattatttgagatacgtctcatctatacctagtttattaagagtttttagcatgaagcgctagtgaattttgtcaaaggccttctctgcatctattgagataataatgtgatttttatctttggttctgtttatatgctggattacgtttattgattttcgtatgttgaaccagccttgcatcccagggatgaagcccacttgatcatggtggataagctttttgatgtgctgctggattcggtttgccagtattttattgaggatttttgcatcaatgttcttcaaggatattggtctaaaattctctttttttgtagtgtctctgctcggctttggtatcaggatgatgctggcctcataaaatgagttagggaggattccctctttttctattgattggaatagtttcagaaggaatggtaccagctcctccttgtacctctggtagaattcggctgtgaatccatctggtcctggactttttttggttggtaagctattaattattgctccaatttcggagcctgttattggtctattcagagattcaacttcttcctggtttagtcttgggatagtgtatgtgtcgaggaatttatccatttcttctagattttctattttatttgcatagaggtgtttatagtattctctgacggtagtttgtatttctgtgggatcagtggtgatatcccctttgtcattttttattgtgtctatttgattcttctctcttttcttcattagtcttcctagcggtctatcaattttgttgatcttttcaaaaaaccagcttctggattcattaattttttgaagggttttttgtgtctctatttctttcagttctgctctgatcttagttatttcttgccttctgctagcttttgaatgtgtttgctcttgcttttctagttcttttaattgtgatgttagggtgtcaattttagatctttcctgctttctgttgtgggcatttagtgctataaatttccctctacacactgctttgaatgtgtcccagagattctggtatattgtgtctttgttctcattggtttcaaggaacatctttatttctgccttcatttcgttatgtacccagtagtcattcaggagcaggttgtttagtttccatgtagttgagcggttttgagtgagtttcttaatcctgagttctagtttgattgcactgtggtctgagagatagtttgttataatttctgttctgttacatttgctgaagagtgctttacttccaactatgtggtcaattttggaataggtgtggtgtggtgctgaaaagaatgtatattctgttgatttggggtggagagttctgtagatgtctattaggtctgcttggtgcagagctgagttcaatttctggatatccttgttaactttctgtctcattgatctgtctaatgttgatagtgggctgttaaagtgtcccattattattgtgtgggattctaagtctctttgtaggtcactaaggacttgctttatgaatctgggtgctcctgtattgggtgtatatatatttaggatagttagttcttcttgttgaattgatccctttactattatgtaatttccttctttgtctctgttgatctttgttggtttaaagtctgtttcatctgagactaggattgcaacccctgtctttttttgttttccattttcttggtagatcttcctccatccctttattttgagcctatgtgtgtctctgcacgtgagatgggttttctgaatacagcacactgatggttcttgactctttatccaatttgacagtctgtgccttttaattggagcatttagcccattgacatttaaggttagtattgttatgtgtgaatttgatcctgtcattatgatgttagctggttattttgctcattagttgatgcagtttcttcctagtcttcatggtctttacaatttggcatgtttttgcagtggctggtaccggttgttcctttccatgtttagtgcttccttcaggagctcttttagggcaggcctggtggtgacaaaatctctcagcatttgcttgtctgtaaagtgtttttttctccttcacgtatgaagctcagtttggctggatatgaaattctgggttgaaaatgcttttctttaagaatgttaaatattggcccccactatcttctggcttctagagtttctgccgagagatccgctgttagtctgacaggcttccctttgtgggtaacccgacctttctctctggctgcccttaacattttttccttcatttcaactttggtgaatctgacaattatgtgtcttggagttgctcttctcgagcagtatctttgtggcattctctgtatttcctgaatctgaatattggccttccttgctagattggggaagttctcctggataatatcctgcagagtgttttccaacttggttccattctccccgtcactttcaggtacaccaatcagacgtagatttggtcttttcacatagtcccatatttcttggaggctttgttcatttctttttattcttttttctctaaacttctcttcatgcttcatttcattcatttcgtcttctatcgctgataccctttcttccagttgatcgcatcggttactgaggcttgtgcattcgtcacgtagttctcgtgccttggttttcagctccaacaggtcctttaaggacttctctgcactggttattctagttatcctttcatctaatattttttcaaagtttttaacttctttgccacgggttcgaacttcctcctttagctcggagtagtttgatcttctgaacccttcctctctcaacttgtcaaagtcattctccatgcagcttcgttccgttgctggtgaggaactgcgttcctttggaggaggagaggcgctctggtttttagagtttctggtttttctgctctgttttttccccatctttgtggttttatctacctttgttccttgatgatggtgatgtacagatgggtttttggtgtggatgtcctttctgtttgttagttttccttctaacagtcaggaccctcagctgcaggtctgtcggagtttactggaggtccactccagaccctgtttgcctgggtatcagcagtggtggctgcagaacagtggatactggtgaaccgcaaatgctgctgcctgattgttcctctggaagttttgtctcacaggagtacccggctatgtgaggtgtcagtctgccccttctggggagtgcctcccagttaggctactcgggggtcagggacccacttgaggaggcagtctgcctgttctcagatctcaagctgcatgctgggaaaactactactctcttcaaagctgtcagacagggacatttaagtctgcagaggttattgctgtcttttgtttgtctgtgccctgcccccagaggtggagcctacagaggcaggcaggcctccttgagctgtggtgggctccacccagttggagcttctgggctgctttgtttatctactcaagcctcagcaatggcaggcgcccctcccccagcctcactgccaccttgcagtttgatctcagactgctgtgctagcaatcagcgaggctcggtgggcttaggaccctcccagccaggtgtggggtataatctcctggtgcaccgtttgtgaagcctgttggaaaagcaaagtattagggtgggagtgacccgattttccaggtgccatctgtcacccctttctttgactaggaaagggaattccctgaccccttgcgcttcccgggtgaggcgatgcctcgccctgctttggctcacacagggtgcgctgtacccactgtcctgcacccactgtctggcactccccagtgagatgaacccagtacctcagctggaaatgcagaaatcacccgtcttctgcgtggctcaggcagggagctgtagactggagctgttcctattcggccatcttggctcccattttttttttttttttgagacgcagtctcactcctgtcgcccaggctggagtgcagtggtgcaatcttggctcactgcaacctctgcctcctgggttcaagctattctcctgcttcagcctcccgagtagctaggattacaggtgcccgtcaccacacctggctaatttttgtacttttagtggagatgggcttttgccacgttggcctgactggtctcaaactcctgacctcaggtggtccgcctgcattggcctcccaaagtgctgggattacaggtgtgagccgccgcgcccggcacttcctgtgctttcataagaacttgtactctcaccgcattatgattacaacagggcagatattctaatccccgtttttgcaggtgagaacccttgagggacagaactgatgagcaatatgcctcatgttggacaactactaagaagtgaaaactcagcaacaatgtgccatacaagcttttattacttttccctaagaaaaaattctagggataaaggaatttaaaatacgtggtgtaaattcagaaaaagacccataattagagcttaataaataaaagagattttttaacaccttaaatttataatcttattctggctaagaattccaatttccttttgccttgaggatataattgcttatatgccaaaggtataagtgaatattttgttgaggtcaacttttataattgtgttctctcaaaaaactggtgttatttgtctatctatggtttataatttctttaccgctatatgtcggtttactaagttgcaagatggttctgccactgcctgcttatacttagtactataatcattattattcctatttaactgatgcaaaaactcagctaaggtgtaaaattccctatgtttatataaccacactttccagttgataaatggatttttagaatgcaggtaaaggattatatagttagaaaaccagtattgtatcaccaccatacattactgaaggtgtcatgatgccctaccaaggatgaaatacaggttgaaagttagtaataattagcatccattcctgtattatcaacccattgcacacatatgtatccttcgatatgtagcctatatgtattgtcagcctcagtacgtactcactacattcccatgctgaattgccctctccttgaaaaaatacagaaatttaagtttgttgtggagattgtcacctgcttcttttttaaagatacacacactttgttctattttttatctaaattgcccccccacccccagttcctgaagcaagcatgtagaatattttccatgatcatatccaaagtggacctgctgcataggagagtcacattgcagttatgtgcacgtgaaaactgagataaattctcctgtctttggtgtgtttataaaatgtgctaagctttcttttaaccatgaataatttaggtatgaccctttctaagtgcaagagaatagatcaaatgctatcctagctctgtgatgatatagctattcccagcaactgaaagaaaagatcatcaaagcctcttacctttctacttactcactcacactgttagaaattatctcaaatgaaaattggccaaaggataagaattaatgtactaagactttgacagcaaatatcattaggagattgtacattccttctattttattgaacaatttctggctaggagatgtccctgaggtccttttctattggttgtattcttatattttcatgtgctgtccaagatgtttatcctgaggttaattttgtgtggataatgctaacagtccatttctgagttttagagctggctcattaatatctatgctgttcagtgtttcaacttgtgtaacaataaggctttcagtttttggatttgtactacagtacgcgtaactgcagttaaacaactggactctgttttttcttcattactctcatgatggtcattatgcagtttttgcatcaggctaaggagacaatctctggctttcattcaagataaagagcaaaatagtatcaaattcccttcaagacaaggaagagtgcctttggccgataatagttcatcatgacataaggaaaactatttcattaaaaatagaagagagaaaaaagggacaagtaggaggaaggctaggggagagatccaaaaaaagattcaattttattaatgcaaaatacccaaacttggagatcaagaaaaaaaaaaacattaaaacatcaaatatatgtttgggttttttttaattctttaaaaacacgaaaaattctgattgaggaaaaacattaaatgcatttttcaggtttatctgaagtcacagataacaatgttaatgaacagacccacatatgaataagtgaaaagacttaagaatgttttctttaaaatcaaactataactgagttcagaggcactctggattttagcaatttaaaagcaatcactgctactaatctaactatgaagaagctcgtaagatacctttaacatatggataataaaattgcaaaagtgccagacacgtgttcgagagatacacgctgagcagcatatacgtgtgcgaaaggcacaatatttcttttccatttgtatggccgtgtaactataattcaagccagcgaagatttatttatgtgacataaagactactagaataataaagagatttttaaattatgtgtatttgtgcaaatagactagaggtcaagaatacttcgatgacataaaaccaccttccctgagaaacgatgttcttgaatgagagtgcaggaattattgatgcagagttgcatagagatagtcagatttgggtggctcagcttctacaagaggaatggaaggtgtaaggtcaagtcccaaagtgttgtccagaactaggttaataatattgaacacctataccaaggaccaggcactttacgcagctacatatagaatctcatttaatccctgccataactctactgggtagatgctattatcaccctctataccaaattaaaagcaaacgtaggcataagtgtctaaagccactggacctgggctcaactcagtttgatttgatccccatatcacctgtaccttttcacagtgacatgcttacttctttataaagtctaggtcatgaatgcaggcaacctttctgaaggtttgacaatggacaaagtctgagaataaaaatagatgagtacaagtgatttggaggttagtacaatttgagaatttaatttatgaacagaattttttatacattatcaggtagccttcatcataatcaccgccagaaagaaaaatcttagaactaggagatagggtcttggtagcggcatgaacaaccttgatcgaatcaactgctttcctggttatgacttataaaaaaaggaattcaaccaaaagctacactgtaaataaactagggtgaggaatttgaagattatcttaacaatatccctaatggaagaagatgggaatgtggacaagaaacagttctctggtaggaaaaaaataatgtaattccttacatgatgaagtaaatacagtgtatgagaaaattcattcagccattcttcatgtaggaaaatccatctatgagaagaaatttaaaaataataaagagataaatagaaggaattggcccaagaggcccttagccaatatgtggatctatgtgtacatactgcttgaaagagggcaaacttcattatactttagatacacatatgctgcaactaaatcatcatggattataaatctctataaagtaaatttttaattaaaccaaggcaaatattgtttaaagctgctatcctatgttaatctcatattctacctgaaatgaattgtcatgaagaataaaatggaagcatagatagttgattatgcttcagaatataaggtaatattgttctttgcatattgtttccttttccttaccttgatttttattctgttctttactcctcctttcacattctttttaaattcataatacctacaattaaattgcaacccttggttctcaaggattctagctttcaaacaggtactcgtgcaactgagcgaacctgttgtaggcctagaaagagcaatgaactgagatgactataaagcagttctctctatgtcccctctttccactgccccagtggacacaggtaagcagctgacaaattctgccatgctttcaactggtcgtcagaagtcctctcgttagaataatattcttccttccatttattataactaaagctttactgataaggataagagctttcaaaaatgtacttttaatggggtgcggtggctcacgcctgtaatcccagcactttgggaggccgaggcaggcggatcacgaggtcaggagatcgagaccatcctggctaacatggtgaaacctcatctctactaaaaatacaaaaaattagccaggcatggtggcgggagcctgtagtcccagctacttgggaggctgaggcaggagaattgctgaacccgggaggcggatctggcagtgagccgagatcgcaccactgcactccagcctgggcgacagagcgagactccatctcgaaaaaaaaaaaaaagtactgccctgataatttgtgatcttaactatttaccaccaaatattacttaacaatgaaaacaataaataaaaataaaaaaaccaattaattcctcaaggtacctcagcagattggtaatgaaatcaaggactaaaaccttagtcttctgtatataaattcaaccctctttttagaatttaattgaaacactttgtgaacccgatcaaacatgtagtttgaacaaatctctatactttaatccagttttggtataaatgatgttttttatgtcataaagaggtgacttgttctgtcatttaaaaaatctattgagtattgtttgttttattccattttttctatattttattatattgtgaactcatccatacagacacattcagtgttgaaggtattgaaagagatgaggattctgccctcaaagaccttaacttctaagaaaagtttgcagtcttaatttgattctgctacttgtgttaggaaatagacaagtgtcatattgctatgaccttttcactgcttaaaacagatggaattgttcttttcaccgcaactttcaacaaagttgtatgtccccactctcaaccttgaaacacccttcttactgtgaatccccaaagatttctgagacagagataaaaaagcaaaattgtgtagaaggcaaatgagggagacactcagaaagaaacaaaaataactaaatcaattggagctcagcaatcttgcacagccaatacacacatgagtcgtggtacccatttattataagatagatgatttgtctttagtacattctgtgtggttatccctagcaccaaatgttttgctattcctattttactgaataagcactctttgcttagctttatttataagtctagtattttctgctcaacactttgtgaacaagtaatgtccctcattttcctgcacatgcctgatttgttccttataatgccaatgattagcatcataatccatgttcttttaagtgtatgttgaaatagatatgcctatattgtgcaccaaagaaaaagaaacaacacccaattagatcacagaaatgggttcaaaaatctttggttcataatgaattgataccacttcgtgatctaacatttaaaccttggaaagactaggttaaagtttaaaatggcaattaagagaagagagcaaaagagtgaaattgtagttttcttctatgagtgtagcaataatgagtaaaggattgaaggatttgttttaaaaaacctgttgccatttactaattgtgagtttgaaaactgtgccttattttaaactctatcttaaaataatttacttgcctgccataaaatgtctgacttatttacattttaactaaacatatcttagctgggaacttctgaaatcgctgtgaacaaggcaatgtgtcatacgtagattggaaagttatatcttttaaataaacaaaacatcttatgttgccttagcactgctgccagagtttataaaggtgaacaatcctgccttaaaagttaaggacactctggtgatcactccaagggtctgttgattgcactttttttatatccttgtaaggctttagatttcattggtccatctagaaaatgggattacctctgacataagagctcatattacatagcaattatgctttatccatagatattgtgcatttaattactgtacaactagccgaaattctttatatagttctccatttttaagtgtaactcaaagaaatatgctcaacataagcaaaattttcttcaagtaaaagaataaaaaacagttgttattgtcctataaatctaatcatggttttgttcattatacttcataaagtattttcaaatgccttatgccattaatgcttacaaaatgtctttgaggaaaatatggtagtattggccatcattatagacacagactgagtcctagtgtttcagttatttttgcctatgttggtagtaaagttgagattcaaccttggtatttttactcagcttagtattcaaaggtgaagttaatctttggtacctgttctctgtgaatcaaaatatttgcaataaatccacaagcttcaaaatgcagtatctttatgtaaactcaagtctttttaaggcctttccattttaaacttcatctattttccctgaagaaggtctacttcaacaagcattggctgtgtcctatgcatactagaaattatgctaggcatgattcgtgctagttctcaaatgttaaacaagctgtatcaggatcaactgggcaactgaaacaaacaaacaaacaaacaaacaaaaaacagcaattccaggcttacttctgaatgaagacatcagacttctaggttacagcatggggatatgggtagtaataaatttcaaatgatctgatcaagagccaaggttgcataaattaaaatacatttaaaaagaaaatataaaagaaaagagaaaatatctaggtggcaaacactgtggaaagacaaggcatattttgatttgaatcactgaaaatcacattaaatgagtgatttagaaaagaatggaggagagttgtgattcattaatttctatggcacagtttatttacggtgtttctttatttataatacatctcataatccacataatagaaaacttactcccaaaaagatttactaaactttggaaatatggagtacatgacataatggatcttaagtgcttagaccacagaaggcatttatattagtttgctaggaccaccataactaaatatctctgactggatatctttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctgactggatatcttaaacaatggaaattaattttctcacagcgctgaaggctagaagtcaaagatcaatgtgccagcaggattggttatttctgagggctctccttgggttgcagacgaccgccctctttgcgcctcttcatatggtagtcccactgtaactgtgcacctctagagtcttttgtgtgtgcaaatttcctcttctttaatgggcaccagtcagattgaattagggcccacctttgtggtttcattttaacttagttacctttttaaaggacctatctccaaatatagtcacaatctaagcaactgggtgttagggattcaacatataaattttggagaacataattcagcccctaacagcttttaataaattttagttgctctgtgttttgtctgattctctacttacttctttatgtcacttacaggattccacacaacccctgtatctgctcagtttcatttgttgctgaaaggttatttgctgtaggaaatctgataacttgaaagcttgttattggagatgatttgtgtatttggggcttctagataaacattcacataaagaggaaggcgggagagtttggtgtttttaccttgaagagtgagtaggctgggaatttctcacaggttgcccaactaacaatggagatcctttcagggttggatgtttaaatggtctgtaaatctatcacatgcacaacttcctattggaactatatctaggtatggacctagatattctatgtgattgtttcagagtctgattttttactttttctgtattctagaaaattaactaataaatattttaagctgacattttaaaattgtaccttcttttccctgtggaaagaacattcatgctttattatttatgtgtctttctttccttctagctttcaagtttttcaaacatatatatctatgcttctttctgctgtcaactttagtgataaaaaagaatttttctcactgcttgtttaaattttcttcagtgagaattccaccacagaaacaaacaaacaaaacaattcaggaaatactaatgcagttttttttttaagtttaacattatgtatggttgtacatttcctgttaaattattatcaacttttcataactggttctgcccttcagcccttggaagccatttgcaagacatttctaaaacactatggaagaaatccagtaaagatagacttgtctaccaacttgacagtcattctttagaaatgcctttgggagagtatcatccattttcttcatttttccccattgagaaatgagctaaactaatttctactgcaatgttaactcatactttcatttcattcagggaacttttcaattacagttttacaaaggaaaatacaattttacgaaggaaaattgtaattttaccttcaggtttattatcaagaattaacagaaattttaatagccagcacagttctttcccattacttaacttgtgagtatgaaaggtaaaatttctaccagattttcagttgctcttgttttggtccaatatgttggtatttgcagggatgaagaaccaggaggccagctggttacagataagttccatattgactgggattccgtactcattgacatggataatgtcattgtagcaagatttgatggcagaggaagtggattccagggtctgaaaattttgcaggagattcatcgaagattaggttcagtagaagtaaaggaccaaataacagctgtgaagtaagtggatgcacatttttcttctctgttttctataatgacagagtcttggtatatgacatataatattactaaccctgactcaaggcttctattttagtgattgagcaattttgtaagttaatcataaagcctatttcattttttttttgaagtacctgtcacccttagtgctataataaaagaattctcatatttcccctctggaattaaaatttactttggatttatggaagttggatacattttaattataccactatattatttgtttacaggaatccacaatgtctgttgtatcctcagttaatcacaattcttgaagtttcacagataccattatcacactggcatgaatgtgtgacctaagaaagttagtgggttctttataatagcacacagaaaccagatatgatattgttcaaatgtagatgttgattcagtaggcctggaatggggcccaggcttctgcatttataacaagctttcaggtgataccaaactactaggccatcactttgagtagcaagattttggagtatatgaccctaatacatgaacagagctacagttagtaaagcatttctagtcattagctattgttttgtatgtatgcatgccaactatatatttatatttgcatttaactcacaaagatataactattgtttttcgttttcattgcagatttttgctgaaactgccttacattgactccaaaagattaagcatttttggaaaggtaaatagtagaaatgctgaatctatctttttatgcgtatctatgttatgtaatatcctattacacattcacaggaggccagttggttacagataagttccatattgactgggattccatacttattaacatggaaaacctcactgtagcaagatttgatggcagaggaagtggattccagagtctgaaatgtatatatataatatatgtatatatacatacatatatgtattatttgtatgtatacatatgtaattacatgcttcattatattataattcctctgtattatcctttaaaaaataacataattagtattatatacagtcagtcatttattaattcagtaactatttattgggcagttagttggcacctggtgtcagaagtagaacaacaacaggacaaaatggggctttgttttcatgaagcttgtgttccagagaggggaaacagtaaagaggtaaatgaaaaacacaatttcatatagtaataagcctcataaagaaaacaaagaaaaactgatacataaaagctaactgcagaagcgcggccagtgtcattagattgagtggtcaatttaggactctctgatgaggttatatttaaacctatacctaaataacaaatggacgctggtcaaataaatctcttgaagcagaatattctccacagaaaaaaactagcaagtatcgcaatcttaggaaaacagacacaggcttagaaactaggaaatgaccagtgtgcataattacgtcatctgtgctctctgcacgatatttacttattgcagtaactgttatgtcaggttcaacattattttgacagtgggaaaatagacctcatatagatatttattagtttgttttttatttttgttttttgttttgttttttttttttttttgagacggagtctcactctgttgccaggctggagtgcagtggcgcgatctgggctcactgcaacctccacctcccaggttcaagcgattctcctgcatcagcctcctgagtagctggggactacaagcacgtgtcaccacgcccagctaatttttgtatttttagtagagacggggtttcaccatgttggccagatggtctcgatctcttgacctcgtgatccgcctgccttggcctcccaaagtgctgggattacaggtgtgagccaccgtgcccagcctattgagcttgtttttaacacatcagtggacaatgtattataaaggtaaaaaggccaggcgcggtggctcacgcctgtaatcccagcactttgggaggccaaggcgggaggatcatgaggtcaggagatagaggccatcttggctaacacggtgaaaccccgtctctactaaaactactaaaaattacccgggcgtggtggcgggcgcctgtagtcccagctactcgggaagctgaggcaggagaatggctgatcccgggaggcagagtttgaagtgagccgagatcgagccaccgcactccagcctgggcgacagagcgagactccgtctcaaaataaaataaaataaaaagatgaaaggaaaagggggaccttgaactattttagtttacaaataaagcaaattcttggtgttcatggatttaaacatatgatattttctactattcataagtaacctagagatccatgacataaaataactggtaagtttaattggggcgtaaattttagtggtacatactgacaggtgggtgtataaaaaaccacttaagaaatgagtaaaatacaaatcagtgcaaatcacgaccatcctctctccacttcaaacatctgcagtgtatcatgcctttgcagcattctacacttgttgtcagcaatattcaacagataagtaaaaatattttgtgagcattgctcctccaacataacacaaagaagtaaataactgaaagtgcatccctagtagtaaaggttagttttttgtttttttttttaaaggaaaacatctaagaaagtgatcatcccaaagaaatggaaaccctagatatattaaaaagtgaaatgaaatcctgtctcagactgcagcactgttaagccttagggacattgtgctaggtgaagatagccagtcacagaaggacaaatactgtataattctacttattacatgaggtgtctagagtggttgagttcatgaaaaaaaagagtgaaatggttgttgccaggatttgaggggagaggaaaaagggaagctggtttttaatggatatataataatggcaagaatgtaaactagtaaagtaaaaaacaaagataaatagagaacaaccaagccagaaaatacagttcattgaaaaaaaagagagggatggaggggtgacaaaaagggagagcaagagcagtaaaggaagaatgtgagtgcaaatgagagcaaggtgctctttagtgattagccattttatgagcccatcagtttcttattagggttcttggaatttttgtctagtttcatatttgcaagatgaaaaagttctggaaatctgtttcacagaaacaaatatatacctgacactacgaaactgtgtgtttaaaagtagttaatagagtaaattttatatgttttaccacatacaaaaaagtacatgcagtagggaatattttactccttaaaagtcctgatacatgtaataatttacaaatggcttagggcctatgtatttcaatgctctgcttactgtacacataaataagcataaaggaccaaataagcttttacaaacattcatggaaatttagagaagattcaaagggttgtaaaatgcctcatggaaaagggcaacatgagctgagtggtgatcagcaggtagaggggaaggaaaagagtctcatgcaaatgcacagtgtcagtgaagggagcatgtgtggagaacatgaaatgaagtagttgactgttattagaagaatgataggcaataagaatgagaggaagactgggccgagacgatagaggatcttcattgccactgagaaattagaagctcagcatataaaccatggaaaaataacactctaggcttcacatttagaagttcaaattctttttccccaaatcgtcattgtatacttgatgtgcctcagagcaaatgactctggaaaactaaaagagtgacataggatacaaacaagtaaaaatatgaatgacttcatcttaaatggaaaaaatattccaggtcaaacaaatatgcatatctgtgactgagttataaattaaaagttgactttctcaccatgtaaaatacactgtttatcctaagattccgtagaccttgcgattcttttttcttgaaatgcactgatttcagattcaaattaggttatgctaacctcataaaacgggttggaaaacaatgttcttgctatactgattccctggaaaaatttgtttaaaattggaactagactataaagaaatttggagctattgctttctgtgtgggattaaacatttaattagtttttaaatttatgtaaccaatagaagactattaagattttgtttaatttcttctgaggtcacctttagtactttgaaaagaatattttttcacttcatataacttttcaagaatatatacaaacagcaatatataatatcctcttattatatgcttaatcatttcacttgtggcagtaatatcccattttgatttctattatgacttactagtgccttcttgcttttgctagggcactctcttgctctcatttgcactcatgttcttcctttattgctcttgctctccctttttgtctctcctccatccctcttttttttgttcagtgaactgtattttctggctggttgttctctatttatctttgattttactttgctagtttaccttcttgccattattatttttcttctactttttatatacattttttcatcaattattaagttgaatgtctagcttattaatttttcattctttctttcaaatacaagcacttaggctgggtttggtggctcacacctgtaatcccagcaccttgggaggccgaggtgggcggatcgcctgaggttgggagttcgagaccatcctgaccaacatggagaaacccctgtctctactaaaaatacaaaactagccgggcatggtggcacatgcctgtaatcccagctacctgggaggctgaggcaggagaatcgcttgaacccaggaggcggagattgtggtgagccgagatcggaccattgcactccagcctgggcaacaagagcgaaactctgtctcaaaacaaaacaaaaaacaaatataagcatttaaattaaaaatccttttgagatgctctctgaggtatttttcactactacagagtacttttattaccatatagtgaaaatatctatttgtcaggataagtctatgtcttctgaacttttcttattatttttatgtcaaattgaatgaaataattttttggtacttttctgtaacttactgactataattgaactgtggccaaagaattgatcaggataacaaaaatactttgaaatatcaattgatttatgagttagggagggaatcattgttttatctttatcaattatttaattttgtgtaattaattttcttattttacttgatcctgattagccattttatgagcctatcagtttcttattagagttcttggaatttttgtttagtgaattgatttttttttcttttttttttttatttcaacagaggtttgaggactaggtggtgtttacttacatgaataagttctttagtggtgatttctgagatttaggtgcacccatcagcagagaagtgtattgtacccagtgtgtagtctttcatcccttacccacctctcactttttccctccaagtccccaaagtccattgcatcattcttgtgcctttgcatcctcatagcttagcttccacttatgagtgagaatatattatgtttggttttccattcctgagttactccacttagaataatggtctccaattccatccaggttgatgtgaatgccattgtttcattcctttttatggctgagtagtattccatggtgtatgtgtgtgtgtgtgtgtgtgtgtgtgtgtgtgtgtgtatctcacaatttctttatccacttgttgattgatgggcatgtgggctgcttccatattttttgcaattatgaattttactgctataaacatgcatatgcaagtatctttttcatataatgacttcttttcctctgggtagatacccaatagtgggattgctagatcaaatggtagttctacttttagttctttaaggaatctccacactgttttccgtagtggttgtactagtttacatttttaaaacttccatgtgtgcctaaaagtgttagtgttacatatatgtccatttaatcaaacatatccattttgatgttcaaataataaacattgattttcactatgtcctcaggaaggtgcattaaagtatccctttataatgtgaactcatcaatttctccttattaatttttctaagtacattttaaggctattattattcagttcctgcaactacagaattattatatcttctggataaatttaatcttttgttgtttttattggccaagtttatctctattaattttttgcattaaagatttttatattcaaattacaataacatccttttttcattgatacatgtttattatcagcctttccaccttattattttcagcactttccgattgatttaggtatgccctttaaacaaaaagagagagagagaaatatgtttttatctttttgccaatttctgtatttttgttgaagattgtattcatttaaatttcttctaattactgataaatttaaatgttactgttttcattatatgtgccattatctgtcctattatatttcttgtgtcttccatttatttgaattgattatttttttctctttcattcttttttctaaatataattttggtttgttcaattatattgctgagaagtattgtattgtatgactataaaataatttgtttatccattcacctacggatgaacatttgcattgtttttagttttgtgtatagttattataaacgtgtacgcttgtttttgtgtaaacatatattttcatatttatttgtaaatacataagagtagaattgttaagtcacatagtaattccatgtttacctgtataaggaatttccatactcttttgaaagtattcatactttgtattttatgttttaggaaccatataggagagtttcatttgttctacatttacgccaacacttaatatcatcagtcttttaaaatcatccacaactgatgaatagtgggatttattttattttcgtttgtagtttactgataactgataatactggacaccttttcatgtgtttattgcttcatataggtatattttaacataactgatttgttgaccattcagactgtgcaacttacactttcatattaaaatttactaagtcacagaaagcatgttacaactgcaaacctattccttccttccccttttcatcatttttaattgagatataattgacataccatgaaattcatccttatatcatatcttaacatcagatagtagtgtcttaaaatcaaatagtagtagttcttccatcttgttcttctttttcaaagttcttttaactcatctagatgtattacatttctttataaattttagaatcactttgtatcttttctaaaaagaaaatacaccatagggatttcttatgtgaattgtatcaaatctataaatcacctggcaaagaaataactgacatctaagcaatattgaagctttcatatttttaaaagataattttgtttggtgttctgttttttctagtatgtgcatagttatagatattttttcattaaccatgtttaggttgtattgggttttctgaatctatgctttggtgctttctgtcaattctagaaaattatcaattttctattagaatattgtcataacttctcatcctccttaaacacttattaaaaatgtgttaaaatctcactttaacatggttattttataaacttttcttggtgccttttggtatttaattctgtgtcatacttgcttctatagtccaataattctctcttcatgtgtgactaatggttttctatattcattgcttaaatttaaaaaaattgttactagaagtttcactgagctttctataaaaatgtttagctatattttaactcttgctttgctgatgtgtatttttaaaaatatatttagcatcattatctgatattttacatcttattaaacaaatatcttttatttttgagtattggtttcttttgcctgttatttctgctgtctctcagtcatggtgatacttttccttgtgtactgtttatttacttgtagatgagtttatctttcttggaattttatctatggggattctttgatgcttttgttgcatttgtatttatgtattatgttttatttttaattgtgtatgctgaattgggaccacacaaaccaagtgtggacttatggctcaaatttttagtcaatattaattattttttattagctcagtacaagctcataacaggaataaaaattaaaacatctcaccaatctcttttatgcagcatgggcttttattttttgtcacatttagacaatgcttttgggatctagatttatttagggtctcctttagacccattgtggattttgtttacgccatccaccaaagaaggcattagaacgaaaggtcaaacaaagtctttagcatgtgaataaaacattggtttcatgctttatttttcacgtttccagctttcagtttgtatttggcttttgtggatttatgagatttatttttagtgtttggggttgtgcctttttctaaagccaccaacttatatttgtgttttatttatttgtttggttggttggttttactttggttttctttagttgagggatcaagtggagtatctgtttcacttaatgctggaaaagaaactgccataaatatgttgttctcatcaatgaggctgaaacaagtcttccttgtaagattctaggctaagttaaatctcaatgtaaaaagcgatgtgattcatttgagatatttcctcaaggaaagaaaagatgattggcagctctagttctaggaatttgcaatttctagtcaacttcttttctttacactcactaatatttgaatgaatttccaggttctgctttttctccttttggtctaagatttaccatgtttttatgatgatatatatctatatctagctagctaaataatttcattcattattatggactttgccagcaaaaactaaacttacactctgagatacatcatactgatatatatacacctccataaagccaaaattatgaaatttaaaaaaatgctcaatgtttttgtcgtgtgtataattgtttagtttaattttttgcttttgagtatggaaatgtttaataaggagctgggatttggcgatggctgtgaggcacgttctttttttatttttaatttttttaaaattttacgttaagtaccacggtacacgtgcagaatgtgcaggtttgttacgtgggtatacatgtgccatggtggtttgctgcacttatcaacccgtcatctaggttttaagccctgcatgcattaggtatttgtcctaatgatctcctttcccttgcgccccaccccccaacaggcaccagtgtgtgattttcccctccctgtgtccatgtgttctcattgttcagctcccacttatgagtgagaacatgcagtgtttggttttctgttcttgtgttagtttgctgagaatgatggcttccagcttcatcaatgtccctgccaagaacatgatctcattcttttttatggccacttcgtattccatggtgtgtatatgctacattttcgttatccagtctatcattgatgggcatttgggttggttccaaatctttctaatccattctaatcagtgttctttaactatgtaaagtgattaaggaatagaatgatggtatttctaagaatagtctttggtcacataatatatattttttagacaatactactacctcttttctatgtattaaaatgttagtcctataaacaccaggaaagcattgattaaattaattaccttctaaacctattacatggatactagaggaaaagagaagagaaacttcagtcagtacaaaagcatagatgtcaacttttgtctttttacatccaattttatttcaatatttcacaagtattcactaaattctaaaagttgcaactattacgtaaaatgggacctaatgatatttcaactgcatttactgttatttactttccaactgcattttctgcaatatagtttaactgaaatctctttgattataagcatgcattccacctttctacctcagtgtctttgttcatgccttttaacttttttctaacagcctctaagcctacatattgctttagaattctatctcttattaagccctattcaggtgtcgtttcctccattaaccattcactcaatctctcccactggaaaacactattccctcctgtgtactcatagaacactttttagtagcttcttgtaatcattataccagtatgtaatgtattacattcatttgtgttctgttttcatttctaagtcagactgtatgctttgtcaagttagttcagttttatttgatttttttgttgcagagacatttgaattgaacttatttcataatctttctttaatttggaattccctctccctctggatatccaaactttatccttttttcaaactccaattcaaacctttcctattctgaaagtctttacctcaatttcacacatagaatgttctataaatatcaatgaagccaaggtgattgaatgtattattcaagctttttatttctttactgattatctgtctactttttctatcaactaatgagagagggtgttgaaatgtttggctatgccataagacaaaattacaacatcttagtctaaaaatcttaattgctttatttgcaattctagaattgggcaagacttcattccatcaaatagaaaaagtgtcccaatgagctgggcagaagaggctggttttatagatagaaaagaactaaagaaagaagtaacaaaaaataaaaagcagattggtcatttcaaagttactttgtgaagcaggaacagttgaaaaataactggtagcatcaggtcacttgaggttacattttgttgtcagaattaaagcagaggaaacatcattatcatgctgattgaaactggcctgtttgggaaattaggctgttaacctcttactcctgctttctaggaaggtcaagtaacaactcagtttgggtttggtgacatggaaactcagcatgagtggctccattttgatttttagtctggtccgttgaggcctagtgcagtagcttagttcaaaacaatgacttcctacaatttttatttaaaggctataattgtctgtttgccttttcctactttcagttctatcagttttggcttcatttatttccatacttttttattgtatagatacatacatgcttaggatcattatttcctcttgattagttgacctctttattgttaagaaatgaccttggccgggcatggtggctcacgctgtaatcccagcactttgggaggcctaggtggctggatcacctgaggtcaggagttcgagaccagcctggccaacgtggtaaaacaccgtctctactaaaaatacaaaaattagccgggcatgatggtaagcacctgtaatcccagctacttggaaggatgaggcaggagaattgcttgaacctgggaggcagaggttacagtgaacaaagatcatgccactgcattccagcctgggcgactttatttttggttatattatctcctttgaaatcttttttgtcagatattaatatagccactccatctttctttggattattgtaaacatgttataaatcttactccattgtttttctttttatctatttgtgtatttacatttacgtattacgtatttatatttaaagtatgtttcttataggctgcaaagagttgggtcttgcttttttattcaatctgacagactctgcatattaaatctctagattttaaataatgtatttagctctttcacctttaatgtaatcattgttattgttgcattaaggtctatcatcttgccatacactttccatttcttctgcttttagtttctttaaaattttgtctagtgtgctttatattaaaagagcattttttataataaaatttgctttgttatttgttaattataactggtctttgcattattttgatggttcctttatggcttataatgtatatttttaactaattaaagttgtcctcctgtgatattattttacttcactcttcaaggtaataagctgtaaacaggtcagtatttatgtatgtatacacatacatatatacacatacatatatatacacatgtacatgtatatgtatatgtatatgtatatatatgtacatatatatgaagtgggatatatcagaggagggcaactgtgtgtgtgtgtgtatgtgtgtgtgtatatatatatatatatatatatatatatatatgctctacagtggtatacttctgtttctctatttctgacctttatgccacagttgtcatacattttatgctacatgttataaatcccaaaatatattgttataatttttgcatttaaaagtcagttatttttatttttatttttattttattttattttatttttttgagacagagttttgctctgttgcccaggctggagtgcaatggtgtgatctcggctcactgcaatctccacctcccgagttcaagcgattctcctgcctcagcctccccagtagctgggattacaggtgtgggccaccatgcccagctaatttttctattattagtagagatgggggtttcaccgttatggccaggctggtctcaaactcctgacctcaggtgatccacaagcgtcggcctcccaaagtgctgggattacaggcatgagccactgcacccggcctaaaagtgagttatttttaaacaaatttaaatatagtgtttaaatgtttatatatttacccaggtgactaccaattccagtgttcatcatttctttgtgtagatacagatttccacctagtctcactttttcttctgcttgaagaacatcctttaaattaccttgtactccaggtgtgcaagtagtatattcttccagctctaatgtgtctttattgcactttaatcttttaaatattttattattttctgggcaaaaagttttaggttgacatttcttattctatactgtaaagatgtttactaccttctggtttgcatttttttcaataagaatatgccatcattcttaacttttttcctctgtatacaacgcatcttttctctgtagatgcttttaataatttctctttatgattaattttaatgaatttcattgtgatatgccttggtatagttttcttcatatgtcttacgcttcagtttattgaatttcttgactatctaggttaagtgtttttaacaaatttggaaattttttattattatttcaaatattttttgttgtccactttctcagggattataaatatgggtagattgggctacttgaagttgtccccaaactcactaatatgctgttcaattttttttttaaaagcatgcatttctttgtatgttccatttcagatagttctgctatgcctcaacttcattcttcaaggtagcaagctgtaacaatgctaggactgacgtgtttatttttcatcattcagggatcaatgtccttcatcagtcaatgtccaatgtcctaaaaacttctattttatatattttgtctatatttttagtcatttcatgtgggaggataaatctcatttctgctgcttcatcacgttggaattgtaaacttttaaataaaataaattgtatatttattaaccattttatatgtctctttttggattgtccatttatccattatatatgcttagtttattttgacttctggtatatatgaacatatatatttgtttccttgttgacatactaaaattttgctatattaaagatagcagtctctgttcacacttgtttgaaatatttcctcagctgcttgaattttgttaaaatttgcatatgatgaggcaaaaaactgaagttctaaaacttggcaaactcttctcaaatgctttcttgggtaatttcttccagtgattttattatttagatgtcctgtttctatcaaaaggctaaatgagtatttattatgttttctctttatttatctgagtttaatagagatgagagagatgcatagcacttgtgaggtatggtgagaatttacttatatagtttcaaatagctagccagtttcctagctccgttggttgactaaatcaacatcattaacagtgataccaactaagaattaagttctcattcatttcagggtttatttctgttgaattctgtctttctgttcttatgctaatcttacagtcttttaattataacatgcttcattataactcattttaatatttttaaaagaattttcactctttacttctctctttgaaaatattcttggctcacctgttctattatctttgtttttttcaaattctcccaaaatatgcaactggaattttttaattaaaatttgtttcaacagttataataatttaagaagaattaaaatagtcacaagatgtagctttcatctgagtcagacaatatgcacagtacatttcttttatttctttttttatatatcctagtagaattttatagctttcttaaaatatgccaaatctctctcctgctgcttttatttctaactattgcttattatttgtgtgttttaatttttattgtaaattgtgtcattttctcagtgttattttctaactagcttgttgggataatggaaaggttatgataatagcatatgtagcttttagctggccactgtttattacttattaattatggatatgacttgattgaagacattaagcaactttagtttgaataattatcctcaggacctaacctcatttaatatataataattttaattttttttaagaattatgtgtaagtgctaaatataaaacaaaactcctagaagcaaaattttatggacatagcttctttaaaaacattaatcacagccgggagcagtggctcatgcgtgtaatcccagcactttgggaggccaaggtgggtggatcacctgaggtcaggagttcgagaacagcctggccaacatggtgaaaccccgtctctgctaaaaaagtacaaaaattggctgggtgtggtggcgagtgtctgtaatcccagctactcaggaggctgaagcaggagaatcgcttgaacccagtaggtggagtttgcagtgagcccaattcccaccactgcactccagcctgggcaacaagagaaaaattctgtctcaaaaaaaaaaaaaaaaaaaattatcacaagaactgaaattaagtttagttgtcttataaacatttttttttagaacagatatcactgtgattaccaggccaaaaaaagattaattcatccaacaaacattattgaatgtacactatgtgcccagcactttttttgaagtgttggaaatacagtggtcaaagagtagaagaaaagtctttctttactgaatttagttcagtaaggagagctatatggaaaacatgtaaactaaacataattggtgaaatacataaaatgtcagatggtgagagtttgattccaaaaagtaaagaagagaaataaataaggatgccaggattagagtgaatgtggccaatttagattggaggtaaggaaaggtatcactaggagatcatgtttgaactaagagaaggcaatgtaaggagataagaactatggatatctggggaaaataaaacaaacttaaaaatgtaaatgaatatgaaagcttcttaaaactttacttagggaggtaattatttgttatgtaaagttttgtatcttttcaattgagggagggcctctcagtgtttgagtccagcttgagtcacttctaaggtttaaagcttcagtatacattatctgcagaattaagatcctgcctccttgaggcaggattaagattctgcttcaaggcaggattataggtattgtgataaaatgtgagtgattatgttaagcgaattaatagttttaatgcaaaataatagagtgtaataaaatttatcttgtatttataaaattctttatttccaattaattcattgtgtaccacaagtgaaatggttcagaaagaattacacaagtttaaattcgcacagatcacttctttctttctttctttctttctttattttgagacggagtcttactcagtcgcccaggctggagtgcagtggcgcgatttcagctcactgcaacctctgcctcctgggttcaagcaattctcctgcctcagcctcctgagtagctgggattagccaccacacctgactaatttttgtatttttagtagagatagggtttcaccatgctggtcaggctggtctccaactccttaccttgtgatccgctggcctcggcctcccaaagtgctgggattacaggcttgagccaccatgtccggcccaaataacctcttgtaaaatcccagtctgtcagtgtatcccttttactatattcataaagtcatttaaagatgatctgaaaacctggggccacagcaaacataaattttgagtaaatggcattgcagatcccacctctgcttctccaagtccttctatctattgaatttagtttcctacatcatgagtatatttcttttaagaaggaaaattctaaggaaacattcctatattttaggcttactaaattaaatttaaaaataacataaacttgttaaacttttgtaagtaatgctaaaatgcttggcaaatgggaatgacaaaacaattttaatgaatagcaaaatccgatcacgggaagaccaataaaatgcacaatgaaaacagagcagcctacactgatgatggaagtttttgatctttattaaatcaaaagtagcctctaatttactacagacgatatggtgattcccattttttaatctacctgatgatatgcattgttttgaaagttgaaagcgttcttatatctacctagaacttatatcttatttttgccctcctctgaagtaaattttccaaaaactcttttgtgatatactattgcattctgtaaatacatataaaacaggtgagaggaaggcgagccattaaaatttaacttattttcatctggggctggtggggcacacctgtaatcccagttctttgggaggccaaggcgagtggatcacttgagcctaggagttcaagaccagcctgggcagccatggcaaaacctatctgtacaaataaatacaaaaattagctgggcacggtggcacgcacctgtggtcccagctactcaggaggcggaagtgggaggtctgcttaagcctgggaggcagcggttgcgatgagcagagattgtgccatgtacttcagcctgggtgacagagtgagaccatgtctaaaataaataaaattattctaatttttgccagtgtcgatttttgtttaaaaatcaattaaagaagcatttgtggttcaattttaaatgctataaatagaattttattcaacagcttttattatcataaagacttagaaaatatttggcttcattaaatgccaaattttcatatttacaaaaatagtaaaatataactccttgtatagcagcaataatttacattcctggttttactgaagaatcacatggggagatccatcaggtgcccattctccacagattgtgattgaatgtgggtcggggagagcactggcactttttttttttaaagcttcactcatctagggaacatcggctgggactaagaagatgtttccggtaggcacctttattatacaattatgcagtaataacttgttgtatataatgtagatcagcagcatagaggtcccctgagagtttattaaaaatgcacaatcttaggtcccaccccaggtctactgaatttgaatctgtatgctgacaacactctcaagtgatttgaattaagttagaagttaagaagcattgttgtgggatctacccctcctttggaaggcactattcctgattcctagagataatcaggctatgagagacatgtgaaactgagataaataaaataaaacaaaccaacaaaaacatataatgtcatcttatatatattatttaaatgtaacataagcttttatggactggaatattcattattctatcaatgttttcaggttatataaacaaacatcataatcagctgaaagtttgcttggccatcatggtattgttaatagaaccagaaaagttgcatgcatcagctaagatgtgtgatgcattcctcactatgggaagagtcttgcctacgggaaatacttgaaatctcttggctgcaacacccttcgcccatctttatgacagagaactaggaacaatatactggaaatgctccctctagggacaacactttcaagagctgtttccacttttgctttatgatacaggttcaacgtacctaatctgaaaatccgaaatttgaaatgctccaaatccaaaatgttttgagcaccgacatcataatgccacgcatggaaaattctacacctgaccctatgtgatgggtcacagtcaaaaatgccattaaaactgtttcatgaacaaaattactaaaaatattctatacaattactgtcaggctgtgtgtataaggtatattaaagcatatatgaatttcatgtttagacttaagttttcatccctgagataacacattatgtgtaggtaaatatccctaaattttaaaagaatccaaaaatcggaaacttctgaccccaagcatttcagataagggatattcagcctttagctatttactttcttgctttgcatagcttaccccaccttcttatttttctttcttaggtaggttaatacatttacctacctaagggaaaatttaaaatgggctacttccagattttgctggcctaagactgtctctctcaatgagaatgagcaaaggcactttgaagtagcttatatctatataggataattttctttccttcagttactaatcgttaaagctttgctcaagcttctgagtactatctaaatattccagtaccagaacaatatatgctatctcagtccattcagtaatgaatgactgcattttgaacttttatgtaccaatttttaaatgatgctccaaatacacataaatgaaattctttatttcttacttcaagagtttagtgacaatgacaataaaactataacctggaccacacttgagtcatctgaaaatctttcaaaagtagacttcatcatgaacaaactgcatcagaatttctgagattgaggcctgaatgttaatattttttaatacctcccaagatgttctgatttccagtagcataaagaacattactgagagtagggctgaaaattaatttctaaaacagatagctcagtaggtcatttttttttttcagcattactgtaattattaaaatctcctctggaacttttctagtcagatcttggtctacaaaagaaaactggacatcttggcttattaaaaaacatttcaagagggtattcaaaattaaacttaaacaataatttaactcatctatctgggaacattattcattatatcccattgctttccaaaacttagttgtgtggaatatagagaagacaattttctcctttactcttcatgagtttttagctaagattccctgcaacaaaaggcagattaacaggagaaaaacaagccgggcgcggtggctcacgcctgtaatcccagcactttgggaggccgaggcgggtagatcacgaggtcaggagatcgagaccatcctggctaacacggtgaaacccgtctctactaaaaatacaaaaaaaattagccgggctggtggcgggcgcctgtggtcccagctgctcgggaggctgaggcaggagaatggcgtgaacccggggggcggagcttgcagtgagcccagggggcggagtttgcagtgaacccagggggcggagcttgaagtgagccgagatcgcaccactgcactccagcctggaccacagagcaagactctgtctaaaaaaaaaaaagcaagagaaaaacaaacagaagcttaataacataaatacctcctttgtacatgggatagaaacaagaaaaatgggcagatctctagagtagatctcaaagaattgtcttatacctcagatgcaaacactaccattctctgaaacaaaggcataaggatgtaggaaaggttttgttaagaaagatgaccaggaaaagcaaaacacaagcaaagtttgtcacgcatagtgaagtcgatttcttctccattgattgagtcttcggttatgtagttattcttctcttcctggtgcggaaagagagggagagaaagagagagagagagacccttgaaaacatctatacatttcctttatagacataaatttatcttacacaagggaaacttccagccttgtttctagtattcttcctgtgtctgcagtttctcaaaatatctagctccaaataatcctaagccagagaggcatatttagggtgaaatagtctgagtgcagccttattttggggtgacatgttctgaactctataagaaattaaaacaatctaaatttttggtgagatattttcaaaatttcattatttcttaattctacataatcatcattatttcagtattttattaaattagtggaaaattacatgtgatttaataagtgctttatttccctaacctcaaattatttggggcaatttccagatgtatagtatgaaatcatggagcaatatttgacatttggtgatgtaattaattttatattttacttaaggcttattaaaacagctgttatataacaatttaaacaaatgttcaaaaatcttaattgtacaaaatgattttggcttttttcccccaagcctgagacattctgatatgatgtacagtaccaaacattgatcaaaagctaaaaatgtctccaggcatagttgttatatataaatttgtgtgtgtgtatgtgtgtgtgtgtgtgtgagatatatatatatatatatatatatttttcccccccagggttatggtggctatattgcatcaatgatcttaaaatcagatgaaaagctttttaaatgtggatccgtggttgcacctatcacagacttgaaattgtatggtgagtactttctacagactgacctagtataatgtattgatttgtagaaaacgaaagcccaatttagaatagctcaattgagctcatttatcatatgttattagagcctgttttcagctgtttatctcctccttgattcagctgattttactaaagcatgacaattaaatgtaaaatgaagaaattaatgaaatatgccagtcaaatagtttttagtttcttctcgaatgtctgttttcttgggtcacagcctcagctttctctgaaagataccttgggatgccatctaaggaagaaagcacttaccaggtaactaatttgaaaataacaaagaaagaggagtatttttgttctaaaaaattagttaaatggcttatttagatctatagatacagatatttgtattttcctttataggcagccagtgtgctacataatgttcatggcttgaaagaagaaaatatattaataattcatggaactgctgacagtaagtattatacttgccgctgctgtttgatagggtatgaccttttacaaagggatacatctaaggacttgcttacaggaagccctgtaaaccttctgaagaagggagcagagagtcacacaaagaatcagatacatgatagaaggtgggaaaaaagaattcagagataagaggagaggaggctattcctcaaatggcagcgttgtccaatcaaactccctgtaatgatggaaatactttatcaatgttgctgaaaaagtagccactggccacttgtggccataccttgtttagtgtgactgaggaactgaattgattttatttaattttaatttaaaaaggcacttgtgtctagtgactatggttacagtgttattcagcacacctaaaatggaaaccaacctggaaaacagaaaccaaaaagctgcaagcactgacatgaaattctaatgaggttacccgcttaaatgaacttaaaaactttaaaaaggcactttcatatcatctctcattttttcatcactttaaaccttggaggtggatgtgattgatgttagtagtaataaataatatcattttatatttacatgacactcttagggaccaaagaatctatattttattatcctctgtgatattttacaacagacagctgaatatttatagcttcattcatggatgagaaaaatcaatttcaaaaaggaaacagatttatccaaggccatctggcaagtgagacaagaaagtcaaagtcttgaatcaatatttcctaaatcttgaacttaacttcttcctctttagggtgggttccactgaatgatttgcttcaagggtactatatggaaaaagagagaaagaggaactttacagtggagaaatttgacaaacatcacatcaacagtgacaagtcatgttattactgttattaaatgcccttgatatgatgtagtggggatggcactttacctccatggtttagtactccaagcccatacataacaccagtctaaccatgagaaaaccatcaggcagatccaaatgaggaaaattctatcagatatccagccagcacccctcagaactgttggggtaatcaaaaaaaaaaaaagtctaagaaactctcatagaccagaggaagtttaaaagacatgatgtctaaatataatgtgggattctgaatggaaccctggaacagaaagggtacacaggaaaacaacaataagaacaccaacaagaaaaactagtgcaccccaaataaagtgggtttagttagtggtagtatatgagtcttagtttctatttgtgacaaagtatataataatataagatgttaacaatggggaaactggaggacgggtatccaggaactctgtactatctctgcaactgttctgaaaatgtaaagcaattatagtattaatagtctattaaagaaagaggtagatgatacagtaccagtgttgggtgaaacatgatgaaagagagcgtaaaaattttgagggacatttggatgttgttctaaggtattaagaccttacatatatatcaacagtaataaaaataaatagcaattatgtactcattgtatgtcagaaaatgtgctaaaagcatttaatattatcttatttgtacttcttgcaaacacggaatagtagatgttattactttcatttaacagattgggaaaataaatattaggaaatgatataacttccttaaaagagtagacacaattgattagtaggaaggagatttgaatccatgtattgagccttttattcactgtgccctgaagccttattcatatgaataaattatattcaaggttaaattattgtatgtctacccatcatgctggactaatatattagtgctatttcaaatttctctgtcaatatgttgtagctataaaggtaaatcattgttctatctgactcactcagtcacaggcctggcgcttcacccatctaataaaatacaagcagaggttcagccctggtccctggagaggaaatgcacctgtgaatgtgtgtgagcacacacacacataggcacacacacacaggcacacacatacacataccacacaacccatacgggcctggtgaattataggtgctcagtcatgacactgtaacaccactactattaatattatcttcaaaaattaccagcaaatgaattcaatcacccagtcaaacctgtaatgttcccttttagctatagtaaacagacaaatagcaacaaatatcaatggactttgcattagaaactaagcagaaaaaaaatccaattggaaaaatccttttgcacatttattttcagctgtctccatgcagacaaataagggatcacattacctctgtcattgaccttattaattagcatttctagaagcttacatttatagagcagtttgtacttatgtagcaatgacaaggtcattttcccattaagtgccataggaagatgttgaaaaagatcttgactatctagttttttaataggtttaaatgattgtttgccattttacattctctgctgtgtggtctgattattcagcattctagagttagagcattaaagaggcttaaactattgataaggctgccctaattttgcaacgacaattaaaaatgttagcttaggctgggcgcggtggctcacacctgtagtcccagcactttgggagaccgaggcaggcagctcacgaggtcaggagtttgagaccagcctgaccaacatggtgaaaccccgtctctactagaaatacaaaaattagctgggcatggtggtgcacgcctataatcccagctactcaggaggctgaggcaggagaactgtttgaacctgggaggcagaggttgcagtgagccgagatcgtaccactgcactccagcctgggcaacagagcaagactccatctcaaaaaaaaaaaaaaaaaaggcagcttaaacatgagttacagaaatctgaagatacacaaactacaggaatgaacaccctagacagaatgtgagccaacttctgcagaaagagatttgagtgactgcaccaaatcttcatagctaccaaacccatggctattgggctgcttacttcagaatcttggatcttaggttctggcagaaggaagataaagcaagagtaaccagtatgctctatattaaatagttagtccttgtataatgagatgtgtattctattttctcagtatggggtattcttttctaattttgaataataaagcagaatgccagtatccaactgagactgtgccctagtaatcttcaaaatgaaatagatagctggtttcctgtattaatatccagaaaagacatttgccatattaaaattttttataaattttataaaatttataaaaatatgtgtaccattaggaataataaatactatccagtaaagtaaatataaacaccattctgtagagtaagtaggacttagttgtagctactgttttgcttttttgtttaatagagtgaagctcaaagttttaccattgtatttgtatttaccagctttctacctaaagccagatataaggttttttggttttttttttttttttttttttgagacggagtcttgctctgtcgcccaggctggactgtagtggcacgatctctgctcactgcaagctccccactcccgggttcacgccattctcctgcctcagcctctcgagtagctgggactacaggtgcccgccaccacaccggctaattttttatattttttaatggagatgggatttcaccgagttagccaggatggtctcgatctcctgaccttgtgatcggcccacctcggcctcccaaagtgctgagattacaggcgtgagccaccgtgcccagccagatataagtcttttaaatgtgcaatgtatgtaaaataaaacactgaatctctttgaaaaataatatgaaaaagttctcatacaagcagtgtgtttcttcagatatcataatttgatttcttgcagcaaaagttcatttccaacactcagcagaattaatcaagcacctaataaaagctggagtgaattatactatgcaggtaagctactttcttagaagaacgtgttttcctgctgtgttttttcacttgtgagatacgcaacacagcttctctattattccattctccctactattattttttaatatgttttttagttaccaaagattgtgttctctgttcctgattacaccgagaatgtggatgaactcatgctttacaagtgaattgcatgaatcctttctaaattgtcattttcctctcagacttattcatatcccaaatattgaattcttttaaaagtaacaagtttctacttcccttcttgttccttttatcttttcttccttttgttgttcctttcttccttttcttgttccttttgtcttgttcctttgtctttattattaaatatgagagtttattattaatttatttttaaatatgataatttataattctcataataaatagtggataaaaaatgtttggggaaatattacaagaaaagaagagaggataaaaggccatttgcactaccatttatgtctgtgcattcatacatttaatatatatttatcaaggacattacagtggtcactctgctctatgagtaacaagacatacattacactgtcaaggaggttccagtctgatataagagtcatagaaggaaaaagtaaagtcatttaaatttctcagcattcagaagaaccaaaagttgctcaacctgtctaaaacacaaactaccacgtttaggataatgaaatatgaagctatacagataaacaaatgtcaggtcattccataagcaatgttgaggagtatggagttttattcaaagggcaatgaggcgccatttaaacctttgtactcaggaattaatgggataatatttgtattttttatttgtattttagaaacagtaacaattttgtttacattggaaagggaattgtcaaagtaaataattgcaccagacaatgttaaagaggcaaggaagaccttatgaaaaactactgcaaaggagacaaagactgaactcaatgctctttaaataaagagctggaaagttttctaaactaaatactcctaaaaaggggaggagaggccaagggcctttagtcaaaaagaaactgtccaaagtttagtcaagctgagggcaaggttagtccatctcagtcaacataaacatgaaaaagtctaccttttatggccaacatattctaatttaaataccaaatattaattgacatgattacaattgttttaaaagtttagcatgaataacttagagtagaattaggtttgattttggtcagatattattactcaaagtttccatgacgttagggctcagaaaatgaatgcgagagacaatagcttcttggataatttgaaatcttctttctcctcaatatcttaggtctacccagatgaaggtcataacgtatctgagaagagcaagtatcatctctacagcacaatcctcaaattcttcagtgattgtttgaaggaagaaatatctgtgctaccacaggaaccagaagaagatgaataatggactgtatttatacagaactgaagggaatattgaggctcaatgaaacctgacaaagagactgtaatattgtagttgctccagaatgtcaagggcagcttacggagatgtcactggagcagcacgctcagagacagtgaactagcatttgaatacacaagtccaagtctactgtgttgctaggggtgcagaacccgtttctttgtatgagagaggtcaaagggttggtttcctgggagaaattagttttgcattaaagtaggagtagtgcatgttttcttctgttatccccctgtttgttctgtaactagttgctctcattttaatttcactggccaccatcatctttgcatataatgcacaatctatcatctgtcctacagtccctgatctttcatggctgagctgcaatctaacactttactgtacctttataataagtgcaattctttcattgtctattattatgcttaagaaaatattcagttaataaaaaacagagtattttatgtaatttctgtttttaaaaagacattattaaatgggtcaaaggacatatagaaatgtggatttcagcaccttccaaagttcagccagttatcagtagatacaatatctttaaatgaacacacgagtgtatgtctcacaatatatatacacaagtgtgcatatacagttaatgaaactatctttaaatgttattcatgctataaagagtaaacgtttgatgaattagaagagatgctcttttccaagctataatggatgctttgtttaatgagccaaatatgatgaaacattttttccaattcaaattctagctattgctttcctataaatgtttgggttgtgtttggtattgtttttagtggttaatagttttccagttgcatttaattttttgaatatgataccttgtcacatgtaaattagatacttaaatattaaattatagtttctgataaagaaattttgttaacaatgcaatgccactgagtgctattttgctcttttggtggagaaggcttttttcaaaactcttggtccttttacttctttctctcagtgcagaatcaattctcattttcatcgtaaaagcaaatagctggattatttcatttgccagtttctatttagtattccatgcctgcccaattcatctgttactgtttaatttcaattcttctggtgagaattagaaatgaaatattttttattcattggccaaaaagttcacagacagcagtgtttgctatttactttgaattgaaggcacaaaatgcatcaattcctgtgctgtgttgacttgcagtagtaagtaactgagagcataaaataaacctgactgtatgaagtcaatttaagtgatgagaacatttaactttggtgactaaagtcagaatatcttctcacttcacttaagggatcttccagaagatatctaaaagtctgtaataagcttagaagttcagataaatctaggcaggatactgcatttttgtggttttaaaaaagtccttaggacagactgaattatcataacttatggcatcaggaggaaactttaaaatatcaaggaatcactcagtcaccctcctgttttgttgaaggatcaaccccaaattctgggtatttgagtacatgtgaatcatggatttggtattcaactttttccctggatgctttggaatcgtgtcttccatgctccactgggttcaatttaaaataggagaggctttctcttctgaaagatccattttaggtctttttcaagaatagtgaacacattttttaacaaaataagttgtaattttaaaaggaaagttttgcctattttattaagatggaaatttctttttaggctaatttgaaatccaactgaagctttttaaccaatattttaaatttgaaccactagagttttttatgatgcaaatgattatgttgtctgaaaggtgtggttttattgaatgtctatttgagtatcatttaaaaagtatttgccttttactgtcatcatttctcttgttttattattattatcaatgtttatctatttttcaattaatttaatacagtttctaatgtgaaagacatttttctggaacccgttttccccttaaacactaaagagacctcaagtgaaagcatattgcttagtaggaaggtagaaaatgttaatccctgcgattctttgagttttaatgacagggtcattttcagtaaaggaaatgctcaccaacacatagtcaccaactattaaaggaatcatgtgattggattttcccctgtatacatgtacccttggtcataatcccactatttcatacatatttatgcattgctagattttcctaggactccaatagcatgctttccaagtgttattattcccttaatgttaa
